United States Patent
Specht et al.

(12) 
(10) Patent No.: US 6,620,923 B1
(45) Date of Patent: Sep. 16, 2003

(54) HUMAN NUCLEIC ACID SEQUENCES FROM ENDOMETRIAL TUMOR TISSUE

(75) Inventors: Thomas Specht, Berlin (DE); Bernd Hinzmann, Berlin (DE); Armin Schmitt, Berlin (DE); Christian Pilarsky, Schonfeld-Weissig (DE); Edgar Dahl, Potsdam (DE); André Rosenthal, Berlin (DE)

(73) Assignee: Metagen Pharmaceuticals GmbH, Berlin (DE)

( * ) Notice: Subject to any disclaimer, the term of this patent is extended or adjusted under 35 U.S.C. 154(b) by 0 days.

(21) Appl. No.: 09/673,395

(22) PCT Filed: Apr. 15, 1999

(86) PCT No.: PCT/DE99/01174

§ 371 (c)(1),
(2), (4) Date: Dec. 27, 2000

(87) PCT Pub. No.: WO99/54461

PCT Pub. Date: Oct. 28, 1999

(30) Foreign Application Priority Data

Apr. 17, 1998 (DE) .......................................... 198 17 948

(51) Int. Cl.[7] .............................. C07H 21/04; C12Q 1/68
(52) U.S. Cl. .................. 536/23.1; 536/25.3; 536/24.31; 536/24.3; 435/6
(58) Field of Search .............................. 536/23.1, 25.3, 536/24.31, 24.3; 530/350

(56) References Cited

U.S. PATENT DOCUMENTS 6,174,992 B1 * 1/2001 Ni et al. ...................... 530/324

FOREIGN PATENT DOCUMENTS

WO    WO 97/34997    * 9/1997 ............. C12Q/1/20

OTHER PUBLICATIONS

Genbank Accession No. AF071219, "Homo sapiens mRNA for lipophilin C." Nov. 26, 1998.*
Genbank Accession No. AJ224173, "Homo sapiens mammaglobin B precursor, mRNA." Mar. 25, 1999.*
Adams M.D. et al.: "EST41316 Endometrial tumor Homo sapiens cDNA 5' end." EMBL Accession No. AA336687, Apr. 18, 1997, XP002127129.

Mahmood Manavi, M.D. et al.: "Amplification and expression of the c–erbB–2 oncogene in Muellerian–derived Genital–tract tumors." Gynecologic Oncology, Bd. 71, Nr. 2, Nov. 1998, Seiten 165–171, XP002127134.

M.F. Arlt et al.: "Frequent deletion of chromosome 1p sequences in an aggressive histologic subtype of endometrial cancer." Human Molecular Genetics, Bd. 5, Nr. 7, 1996, Seiten 1017–1021, XP002127133.

To Hoa Thai et al.: "Mutations in the BRCA1–associated RING domain (BARD1) gene in primary breast, ovarian and uterine cancers." Human Molecular Genetics, Bd. 7, Nr. 2, 1998, Seiten 195–202, XP002127132.

E. Strunck et al.: "Basement membrane regulates gen expression in HEC1B(L) Endometrial adenocarcinoma cells." Biochemical and Biophysical Research Communications., Bd. 221, Nr. 2, 1996, Seiten 346–350, XP002127131.

Adams M.D. et al.: "EST41427 Endometrial tumor Homo sapiens cDNA 5' end." EMBL Accession No. AA336787, Apr. 18, 1997, XP002127130.

Mahmood Manavi, M.D. et al.: "Amplification and expression of the c–erbB–2 oncogene in Muellerian–derived Genital–tract tumors." Gynecologic Oncology, Bd. 71, Nr. 2, Nov. 1998, Seiten 165–171, XP002127134.

M. Sakata et al.: "Messenger RNA differential display reverse–transcriptase–polymerase–chain–reaction analysis of a progestogen–suppressive gene in a human endometrial–cancer cell line." International Journal of Cancer, Bd. 78, Nr. 1, Sep. 25, 1998, Seiten 125–129, XP002127136.

A. Koul et al.: "A somatic BRCA2 mutation in RER+ endometrial carcinomas that specifically deletes the amino- –terminal transactivation domain" Genes, Chromosomes & Cancer, Bd. 24, Nr. 3, Mar. 1999, Seiten 207–212, XP002127135.

* cited by examiner

Primary Examiner—Gary Benzion
Assistant Examiner—Jeanine Goldberg
(74) Attorney, Agent, or Firm—Millen, White, Zelano & Branigan, P.C.

(57) ABSTRACT

Human nucleic acid sequences—mRNA, cDNA, genomic sequences—from endometrial tumor tissue, which code for gene products or portions thereof, and their use, are described. In addition, the polypeptides that can be obtained by way of the sequences and their use are described.

1 Claim, 10 Drawing Sheets

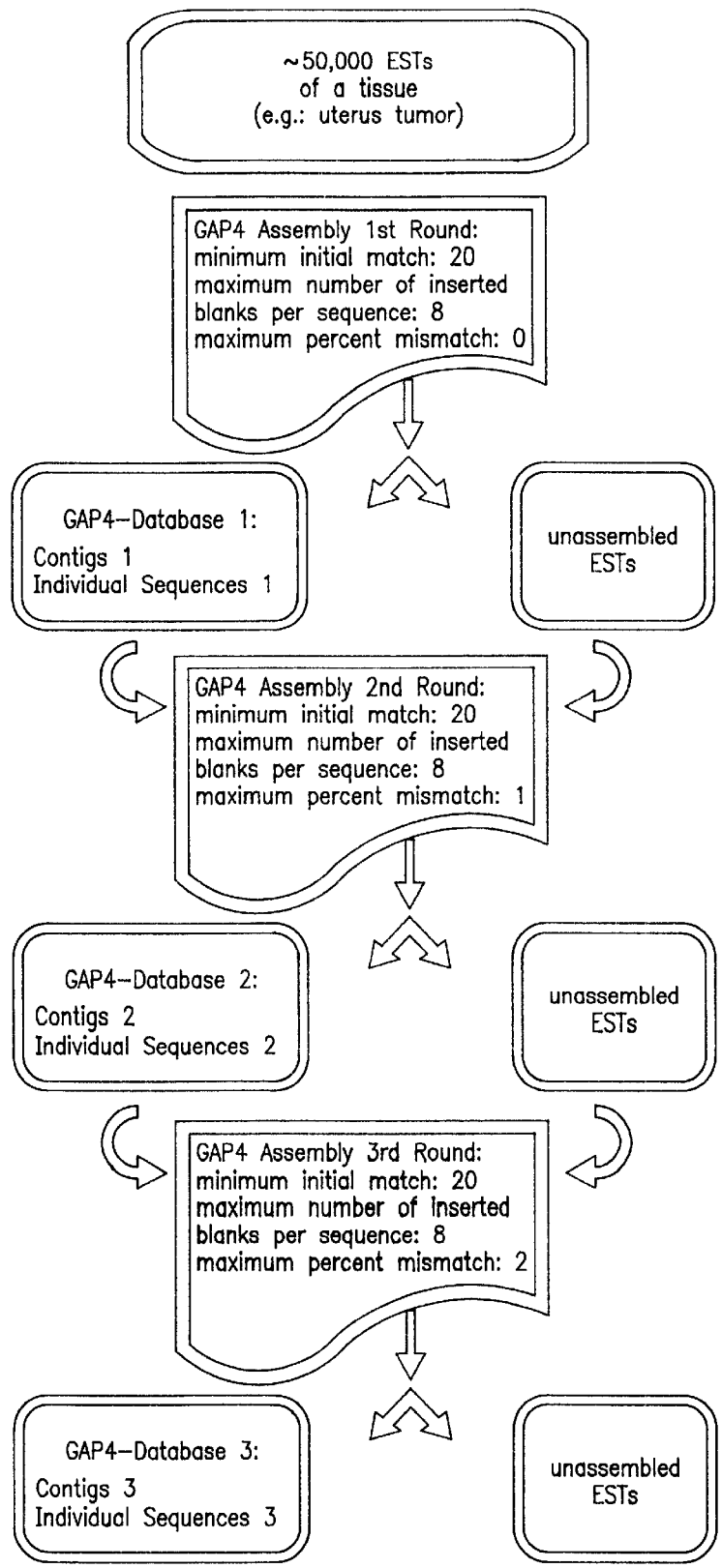
FIG. 2b-I

HUMAN NUCLEIC ACID SEQUENCES FROM ENDOMETRIAL TUMOR TISSUE

The invention relates to human nucleic acid sequences from endometrial tumors, which code for gene products or portions thereof, their functional genes that code at least one bioactive polypeptide and their use.

In addition, the invention relates to the polypeptides that can be obtained by way of the sequences and their use.

One of the main causes of death by cancer in women is the endometrial tumor, for control of which new therapies are necessary. Previously used therapies, such as, e.g., chemotherapy, hormone therapy or surgical removal of tumor tissue, frequently do not result in a complete cure.

The cancer phenomenon often goes along with overexpression or underexpression of certain genes in degenerated cells, it still being unclear whether these altered expression rates are the cause or the result of the malignant transformation. Identification of these genes would be an important step for development of new therapies against cancer. Spontaneous formation of cancer is often preceded by a host of mutations. They can have the most varied effects on the expression pattern in the affected tissue, such as, e.g., underexpression or overexpression, but also expression of shortened genes. Several such changes due to these mutation cascades can ultimately lead to malignant degeneration. The complexity of these relationships makes an experimental approach very difficult.

A database that consists of so-called ESTs is used to look for candidate genes, i.e., genes that compared to the tumor tissue are more strongly expressed in normal tissue. ESTs (expressed sequence tags) are sequences of cDNAs, i.e., mRNAs transcribed in reverse, therefore molecules that reflect gene expression. The EST sequences are determined for normal and degenerated tissue. These databases are offered to some extent commercially by various companies. The ESTs of the LifeSeq database, which is used here, are generally between 150 and 350 nucleotides long. They represent a pattern that is unmistakable for a certain gene, although this gene is normally very much longer (>2000 nucleotides). By comparison of the expression patterns of normal and tumor tissue, ESTs can be identified that are important for tumor formation and proliferation. There is, however, the following problem: Since the EST sequences that are found can belong to different regions of an unknown gene due to different constructions of cDNA libraries, in this case a completely incorrect ratio of the occurrence of these ESTs in the respective tissue would arise. This would only be noticed when the complete gene is known and thus ESTs can be assigned to the same gene.

It has now been found that this possibility of error can be reduced if all ESTs from the respective tissue type are assembled beforehand, before the expression patterns are compared to one another. Overlapping ESTs of the same gene were thus combined into longer sequences (see FIG. 1, FIG. 2a and FIG. 3). This lengthening and thus coverage of an essentially larger gene region in each of the respective bases are intended to largely avoid the above-described error. Since there were no existing software products for this purpose, programs for assembling genomic sections were employed, which were used modified and to which our own programs were added. A flow chart of the assembly procedure is shown in FIGS. 2b1–2b4.

Nucleic acid sequences Seq. ID No. 1 to Seq. ID No. 141 and Seq. ID Nos. 531–552, 554, and 555, which play a role as candidate genes in endometrial tumors, have now been found.

Nucleic acid sequences Seq. ID Nos. 1–126 and Seq. ID Nos. 531–552, 554, and 555 are of special interest.

The invention thus relates to nucleic acid sequences that code a gene product or a portion thereof, comprising a) a nucleic acid sequence selected from the group of nucleic acid sequences Seq. ID Nos. 1–126 and Seq. ID Nos. 531–552, 554, and 555, b) an allelic variation of the nucleic acid sequences named under a) or c) a nucleic acid sequence that is complementary to the nucleic acid sequences named under a) or b).

In addition, the invention relates to a nucleic acid sequence according to one of the sequences Seq. ID Nos. 1–126 or a complementary or allelic variant thereof and the nucleic acid sequences thereof, which have 90% to 95% homology to a human nucleic acid sequence.

The invention also relates to nucleic acid sequences Seq. ID No. 1 to Seq. ID No. 141 and Seq. ID Nos. 531–552, 554, and 555, which are expressed elevated in the endometrial tumor.

The invention further relates to nucleic acid sequences comprising a portion of the above-mentioned nucleic acid sequences in such a sufficient amount that they hybridize with sequences Seq. ID Nos. 1–126 and Seq. ID Nos. 531–552, 554, and 555.

The nucleic acid sequences according to the invention generally have a length of at least 50 to 4500 bp, preferably a length of at least 150 to 4000 bp, especially a length of 450 to 3500 bp.

With the partial sequences Seq. ID Nos. 1–126 and Seq. ID Nos. 531–552, 554, and 555 according to the invention, expression cassettes can also be built using current process practice, whereby on the cassette at least one of the nucleic acid sequences according to the invention is combined with at least one control or regulatory sequence generally known to one skilled in the art, such as, e.g., a suitable promoter. The sequences according to the invention can be inserted in a sense or antisense orientation.

A large number of expression cassettes or vectors and promoters which can be used are known in the literature.

Expression cassettes or vectors are defined as: 1. bacterial, such as, e.g., phagescript, pBs, φX174, pBluescript SK, pBs KS, pNH8a, pNH16a, pNH18a, pNH46a (Stratagene), pTrc99A, pKK223-3, pKK233-3, pDR540, pRIT5 (Pharmacia), 2. eukaryotic, such as, e.g., pWLneo, pSV2cat, pOG44, pXT1, pSG (Stratagene), pSVK3, pBPV, pMSG, pSVL (Pharmacia).

Control or regulatory sequences are defined as suitable promoters. Here, two preferred vectors are the pKK232-8 and the PCM7 vector. In particular, the following promoters are intended: lacI, lacZ, T3, T7, gpt, lambda $P_R$, trc, CMV, HSV thymidine-kinase, SV40, LTRs from retrovirus and mouse metallothionein-I.

The DNA sequences located on the expression cassette can code a fusion protein which comprises a known protein and a bioactive polypeptide fragment.

The expression cassettes are likewise the subject matter of this invention.

The nucleic acid fragments according to the invention can be used to produce full-length genes. The genes that can be obtained are likewise the subject matter of this invention.

The invention also relates to the use of the nucleic acid sequences according to the invention and the gene fragments that can be obtained from use.

The nucleic acid sequences according to the invention can be moved with suitable vectors into host cells, in which as the heterologous part, the genetic information which is contained on the nucleic acid fragments and which is expressed is located.

The host cells containing the nucleic acid fragments are likewise the subject matter of this invention.

Suitable host cells are, e.g., prokaryotic cell systems such as E. coli or eukaryotic cell systems such as animal or human cells or yeasts.

The nucleic acid sequences according to the invention can be used in the sense or antisense form.

Production of polypeptides or their fragments is done by cultivation of the host cells according to current cultivation methods and subsequent isolation and purification of the peptides or fragments, likewise using current methods. The invention further relates to nucleic acid sequences, which code at least a partial sequence of a bioactive polypeptide.

This invention further relates to polypeptide partial sequences, so-called ORF (open-reading-frame)-peptides, according to the sequence protocols Seq. ID Nos. 142–528 and Seq. ID Nos. Seq. 561–575, 577–625, and 630–635.

The invention further relates to the polypeptide sequences that have at least 80% homology, especially 90% homology to the polypeptide partial sequences of ORF ID Nos. 142–528 and Seq. ID Nos. ORF 561–575, 577–625, and 630–635 according to the invention.

The invention also relates to antibodies that are directed against a polypeptide or a fragment thereof and that are coded by the nucleic acids of sequences Seq. ID No. 1 to Seq. ID No. 141 and Seq. ID Nos. 531–552, 554, and 555 according to the invention.

Antibodies are defined especially as monoclonal antibodies.

The antibodies according to the invention can be identified by, i.a., a phage display process. These antibodies are also the subject matter of the invention.

The polypeptide partial sequences according to the invention can be used in a phage display process. The polypeptides that are identified with this process and that bind to the polypeptide partial sequences according to the invention are also the subject matter of the invention.

The nucleic acid sequences according to the invention can also be used in a phage display process.

The polypeptides of sequences Seq. ID Nos. 142–528 and Seq. ID Nos. Seq. 561–575, 577–625, and 630–635 according to the invention can also be used as tools for finding active ingredients against endometrial tumors, which is likewise the subject matter of this invention.

Likewise the subject matter of this invention is the use of nucleic acid sequences according to sequences Seq. ID No. 1 to Seq. ID No. 141 and Seq. ID Nos. 531–552, 554, and 555 for expression of polypeptides, which can be used as tools for finding active ingredients against endometrial tumors.

The invention also relates to the use of the found polypeptide partial sequences Seq. ID Nos. 142–528 and Seq. ID Nos. 561–575, 577–625, and 630–635 as pharmaceutical agents in the gene therapy for treatment of uterus tumors or for the production of a pharmaceutical agent for treatment of uterus tumors.

The invention also relates to pharmaceutical agents that contain at least one polypeptide partial sequence Seq. ID Nos. 142–528 and Seq. ID Nos. Seq. 561–575, 577–625, and 630–635.

The nucleic acid sequences found according to the invention can also be genomic or mRNA sequences.

The invention also relates to genomic genes, their exon and intron structures and their splice variants that can be obtained from cDNAs of sequences Seq. ID No. 1 to Seq. ID No. 141 and Seq. ID Nos. 531–552, 554, and 555, and their use together with suitable regulatory elements, such as suitable promoters and/or enhancers.

With the nucleic acids according to the invention (cDNA sequences) Seq. ID Nos. 1–141 and Seq. ID Nos. 531–552, 554, and 555, genomic BAC, PAC and cosmid libraries are screened, and specifically human clones are isolated via complementary base pairing (hybridization). The BAC, PAC and cosmid clones isolated in this way are hybridized using fluorescence-in-situ hybridization on metaphase chromosomes, and the corresponding chromosome sections on which the corresponding genomic genes lie are identified. BAC, PAC and cosmid clones are sequenced in order to clarify the corresponding genomic genes in their complete structure (promoters, enhancers, silencers, exons and introns). BAC, PAC and cosmid clones can be used as independent molecules for gene transfer (see FIG. 5).

The invention also relates to BAC, PAC and cosmid clones containing functional genes and their chromosomal localization according to sequences Seq. ID No. 1 to Seq. ID No. 141 and Seq. ID Nos. 531–552, 554, and 555, for use as vehicles for gene transfer.

Meanings of Technical Terms and Abbreviations

| | |
|---|---|
| Nucleic acids = | Nucleic acids in this invention are defined as: mRNA, partial cDNA, full-length cDNA and genomic genes (chromosomes) |
| ORF = | Open Reading Frame, a defined sequence of amino acids which can be derived from the cDNA sequence |
| Contig = | A set of DNA sequences that can be combined as a result of very great similarities into one sequence (consensus) |
| Singleton = | A contig that contains only one sequence |
| Module = | Domain of a protein with a defined sequence, which represents one structural unit and which occurs in various proteins |
| N = | selectively the nucleotide A, T, G or C |
| X = | selectively one of the 20 naturally occurring amino acids |

Explanation of the Alignment Parameters
minimal initial match=minimal initial identity area
maximum pads per read=maximum number of insertions
maximum percent mismatch=maximum deviation in %

EXPLANATION OF FIGURES

FIGS. 2b1–2b4 show the entire principle of EST assembling

The following examples explain the production of the nucleic acid sequences according to the invention without limiting the invention to these examples and nucleic acid sequences.

EXAMPLE 1

Search for Tumor-Related Candidate Genes

First, all ESTs of the corresponding tissue from the LifeSeq database (from October 1997) were extracted. They were then assembled by means of the GAP4 program of the Staden package with the parameters 0% mismatch, 8 pads per read and a minimal match of 20. The sequences (fails) not recorded in the GAP4 database were assembled first at 1% mismatch and then again at 2% mismatch with the database. Consensus sequences were computed from the contigs of the database that consisted of more than one sequence. The singletons of the database, which consisted of only one sequence, were re-assembled at 2% mismatch with the sequences not recorded in the GAP4 database. In turn, the consensus sequences were determined for the contigs.

All other ESTs were re-assembled at 4% mismatch. The consensus sequences were extracted once again and finally assembled with the previous consensus sequences and the singletons and the sequences not recorded in the database at 4% mismatch. The consensus sequences were formed and used with the singletons and fails as the initial basis for tissue comparisons. This procedure ensured that among the parameters used, all sequences represented gene regions independent of one another.

Figure 1:
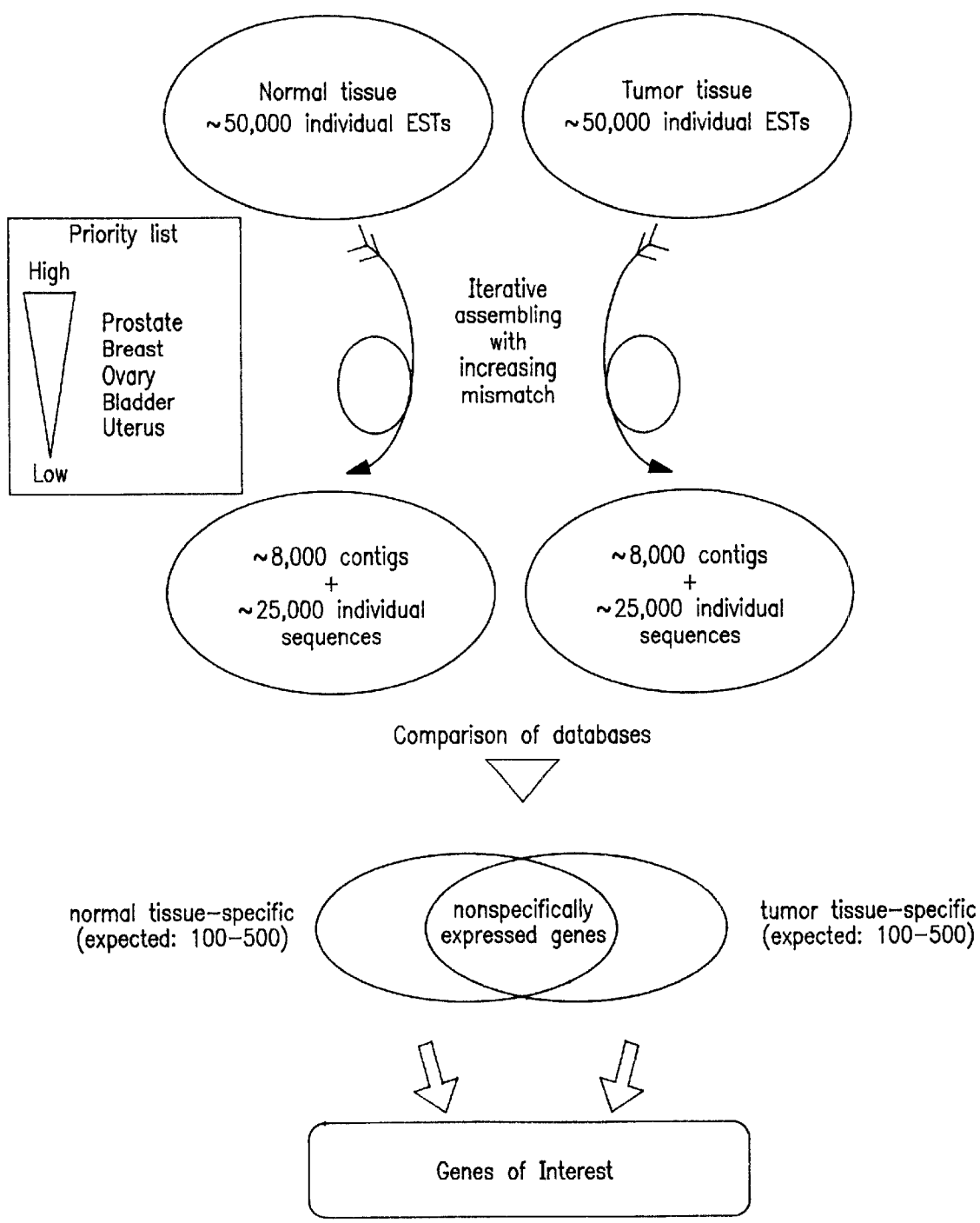
FIG. 1 shows the systematic gene search in the Incyte LifeSeq database
Figure 2A:
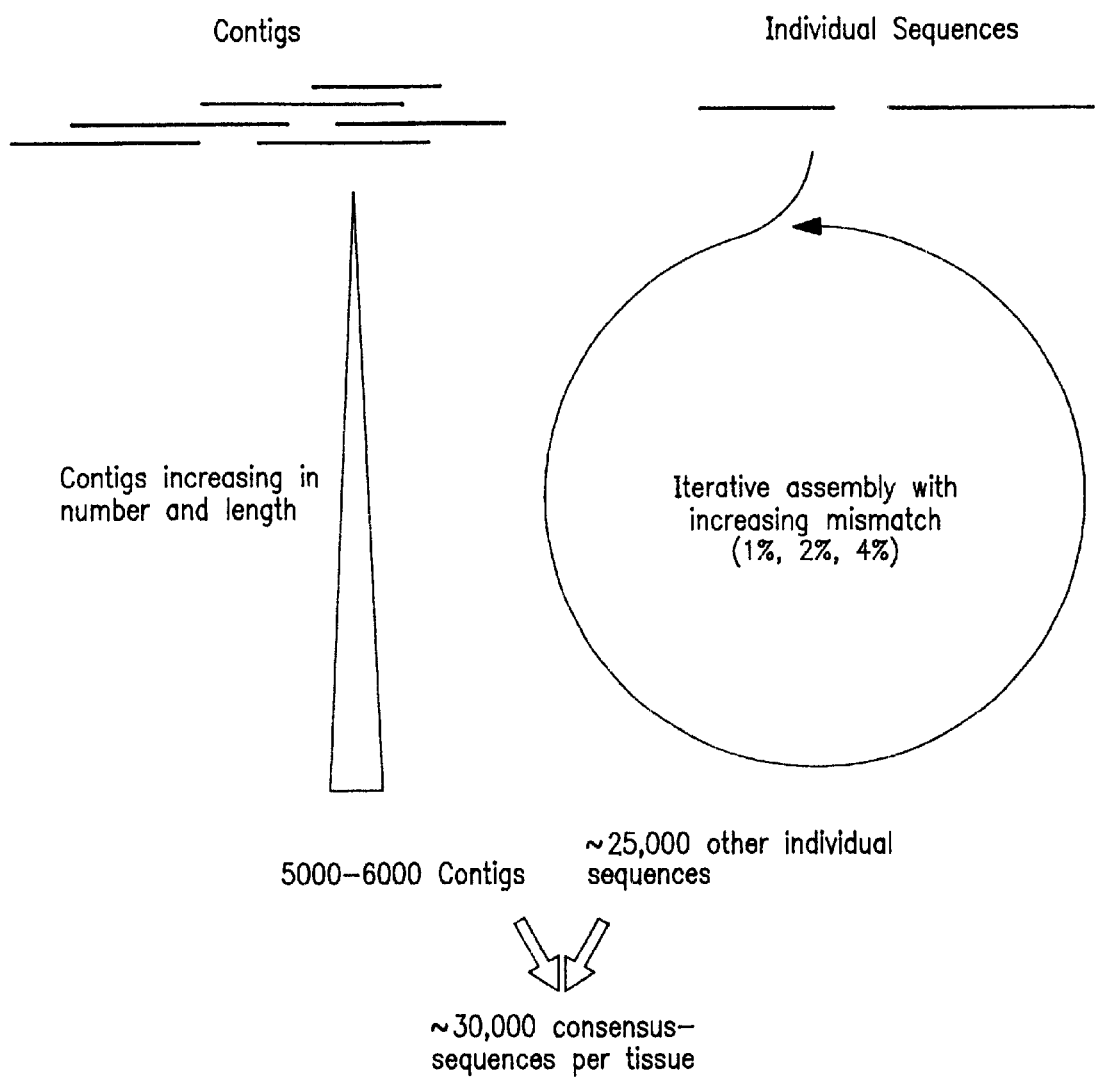
FIG. 2a shows the principle of EST assembling
Figures 2, 2B:
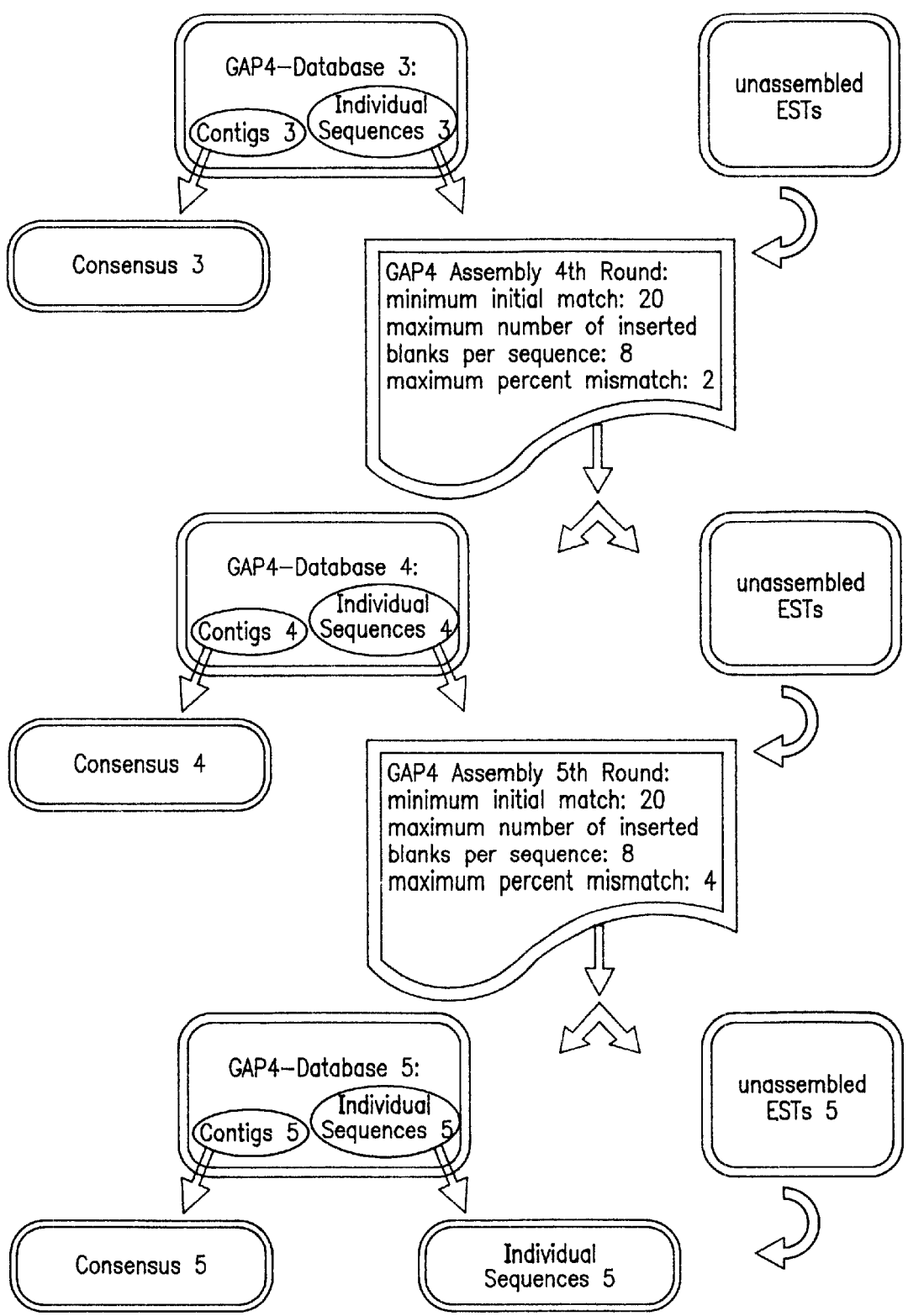
Figures 2, 2B, 3:
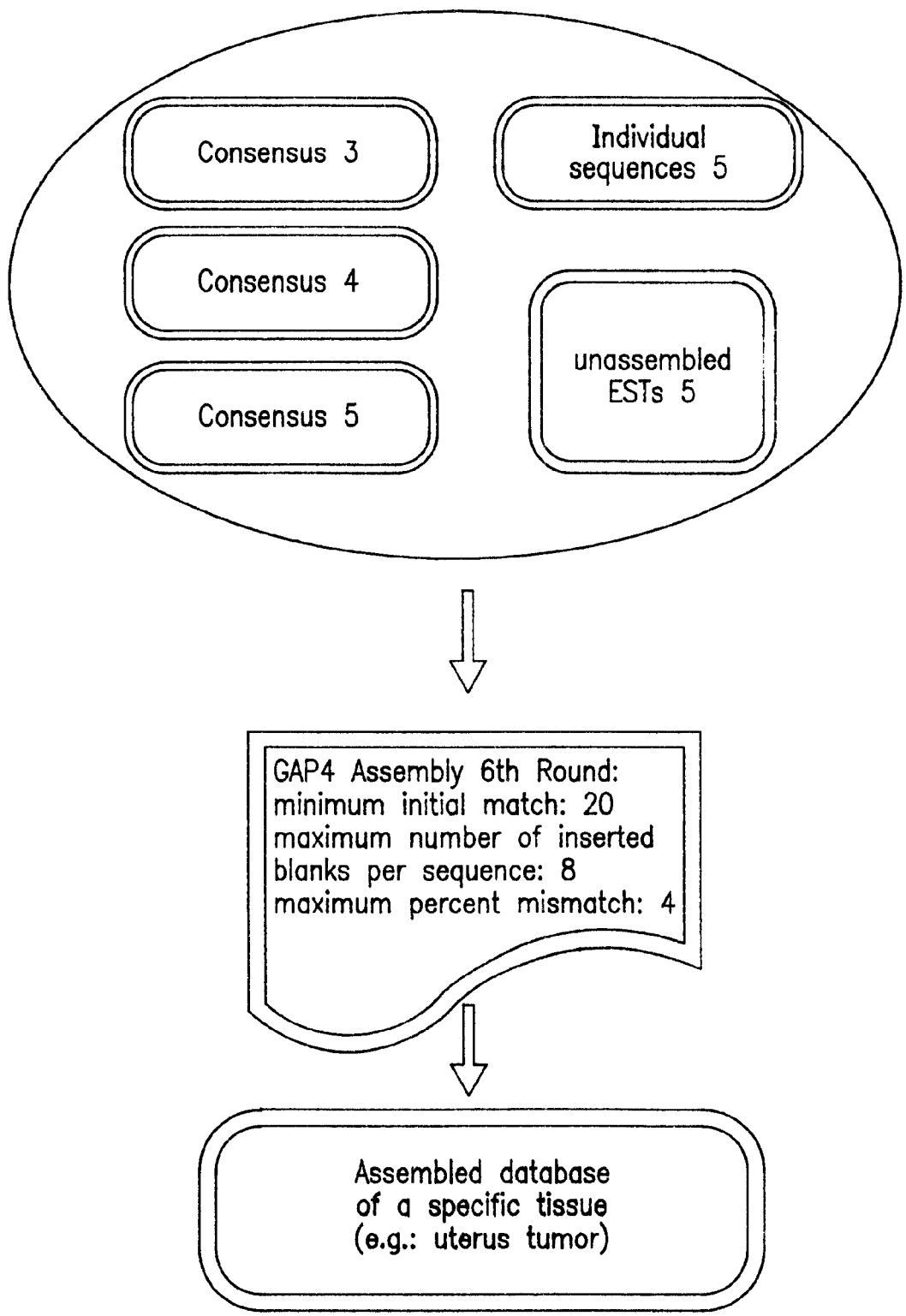
Figures 2, 2B, 3, 4:
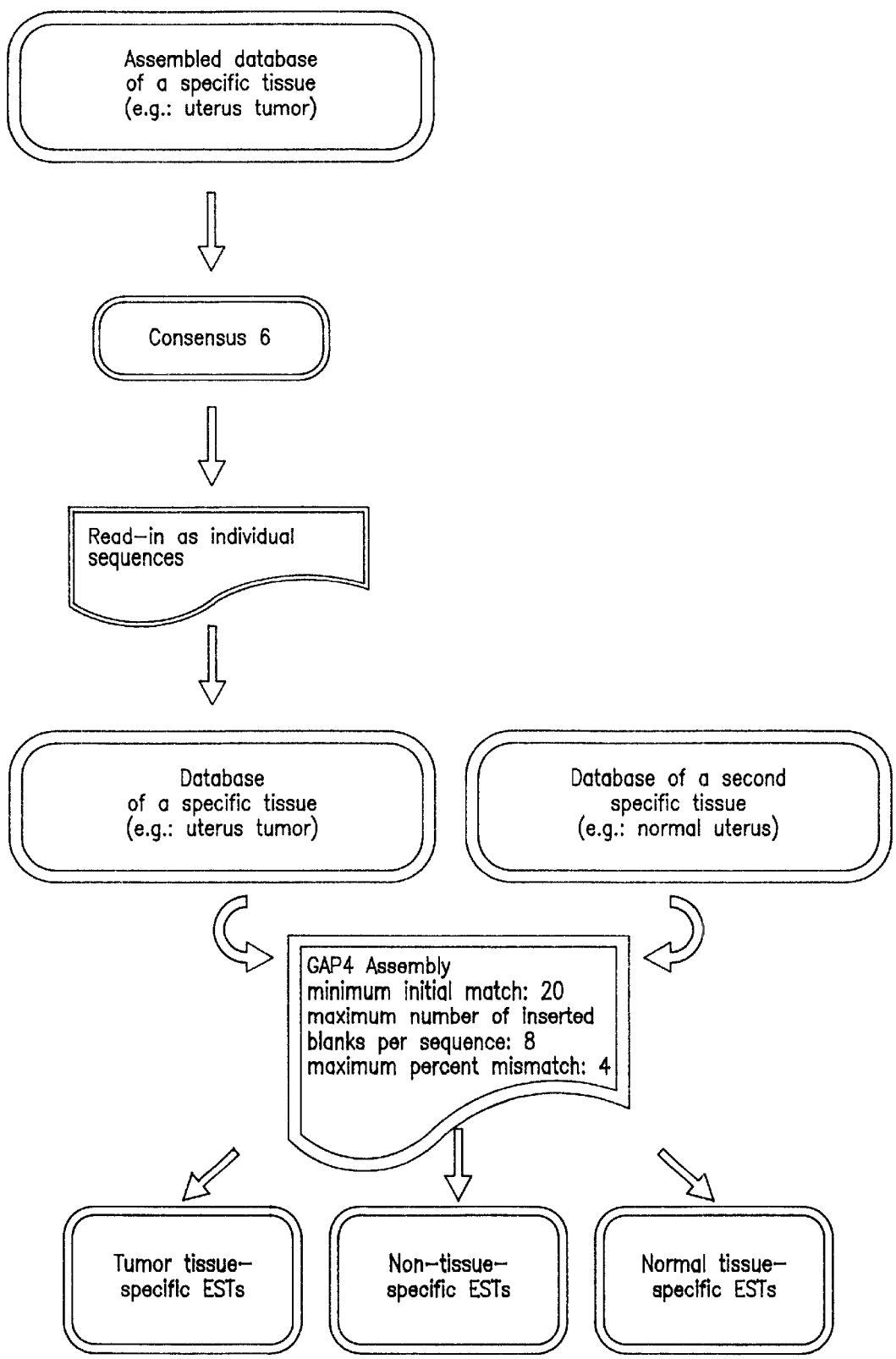
Figure 3:
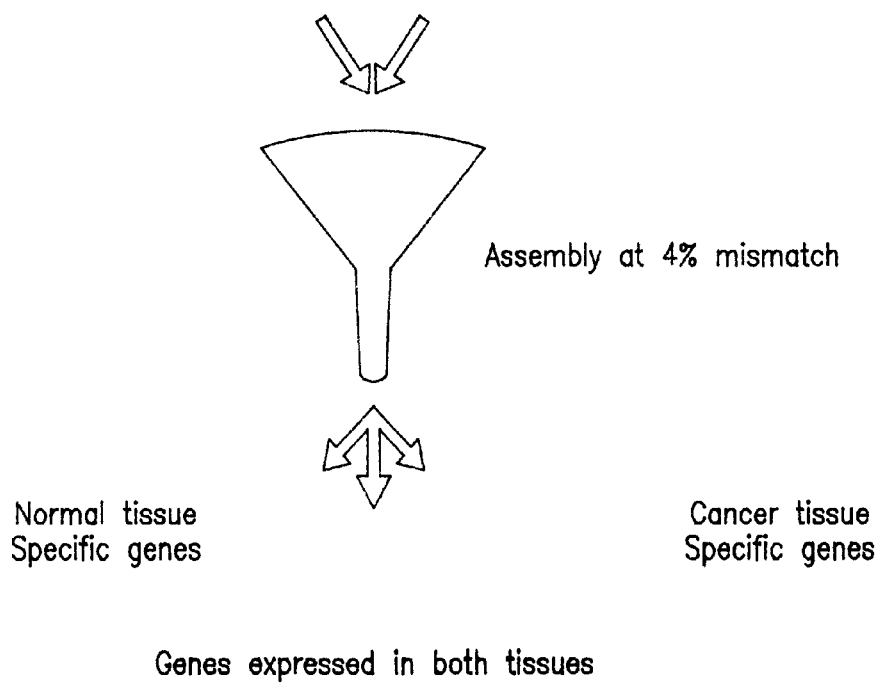
FIG. 3 shows the in-silico subtraction of gene expression in various tissues

FIGS. 2b1–2b4 illustrate the lengthening of the uterus tissue ESTS.

The sequences of the respective tissue assembled in this way were then compared to one another by means of the same program (FIG. 3). To do this, first all sequences of the first tissue were input into the database. (It was therefore important that they were independent of one another.)

Then, all sequences of the second tissue were compared to all those of the first. The result was sequences that were specific to the first or the second tissue as well as those which occurred in both. In the latter, the ratio of the frequency of occurrence in the respective tissue was evaluated. All programs pertaining to the evaluation of the assembled sequences were themselves developed.

Figure 4A:
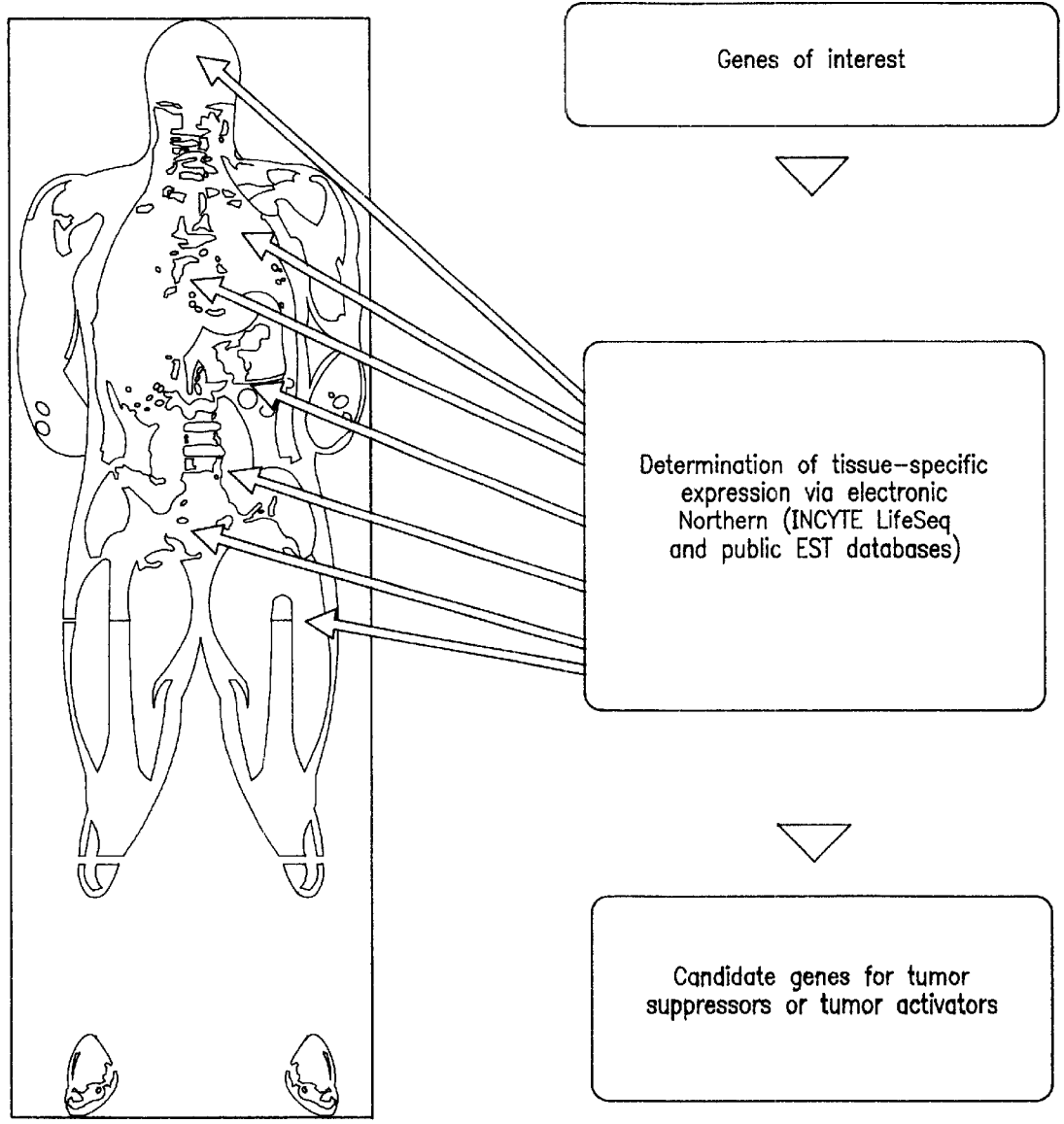
FIG. 4a shows the determination of tissue-specific expression via electronic Northern
Figure 4B:
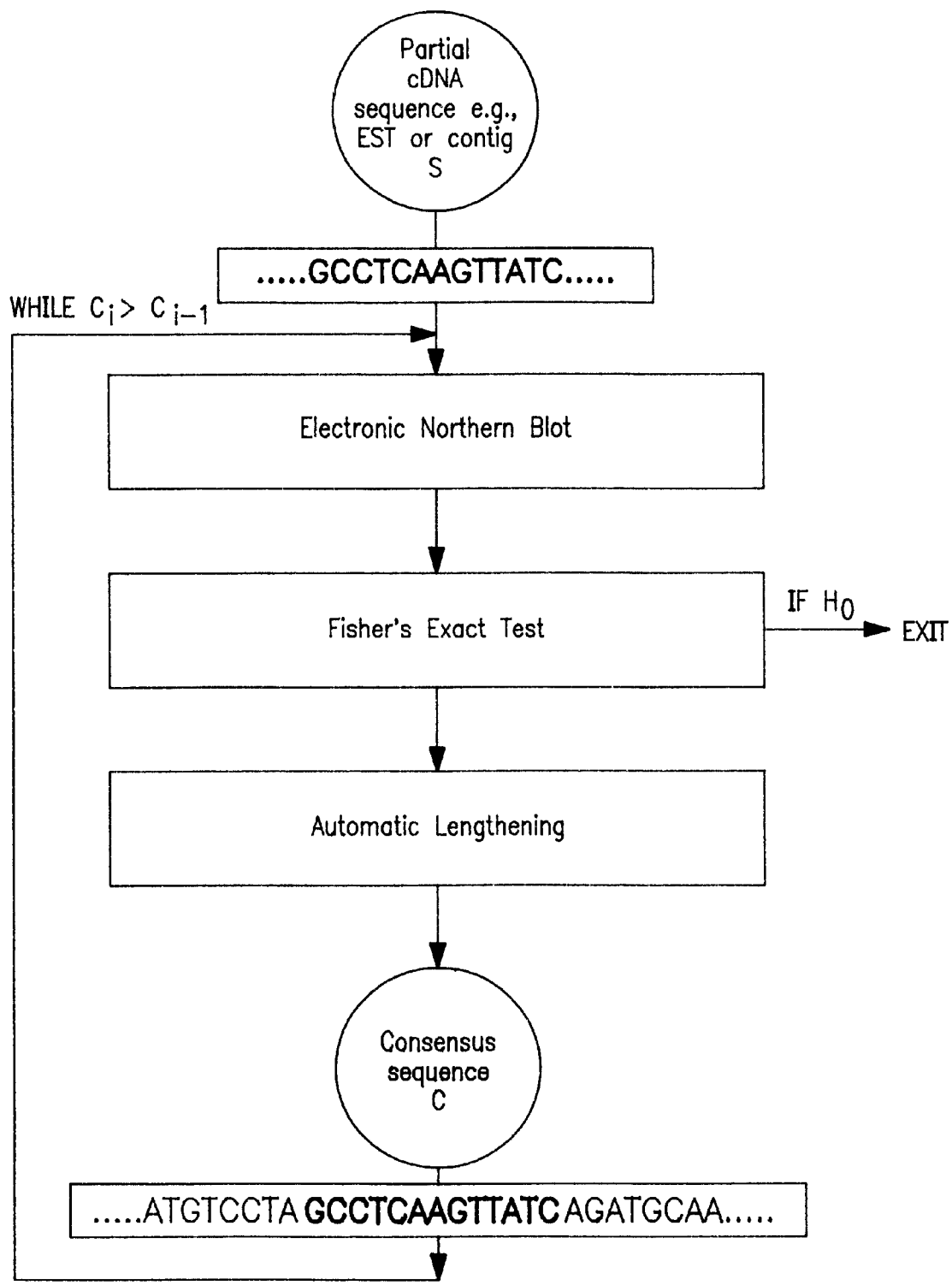
FIG. 4b shows the electronic Northern
Figure 5:
FIG. 5 shows the isolation of genomic BAC and PAC clones.
Figure 5:
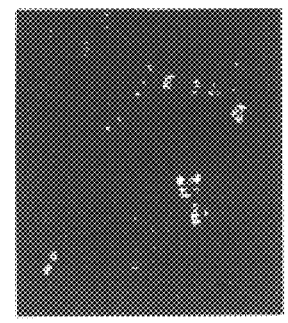
Figure 5:
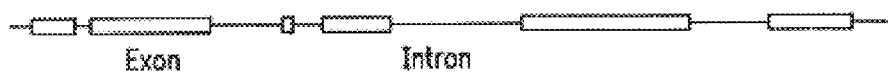

All sequences that occurred more than four times in respectively one of the compared tissues and all that occurred at least five times as often in one of the two tissues were further studied. These sequences were subjected to an electronic Northern (see Example 2.1), by which the distribution in all tumor and normal tissues was studied (see FIG. 4a and FIG. 4b). The relevant candidates were then lengthened using all Incyte ESTs and all ESTs of public databases (see Example 3). Then, the sequences and their translation into possible proteins were compared to all nucleotide and protein databases and were studied for possible regions that code for proteins.

EXAMPLE 2

Algorithm for Identification and Lengthening of Partial cDNA Sequences with Altered Expression Pattern An algorithm for finding overexpressed or underexpressed genes will be explained below. The individual steps are also summarized in a flow chart for the sake of clarity (see FIG. 4b).

2.1. Electronic Northern Blot

By means of a standard program for homology search, e.g., BLAST (Altschul, S. F.; Gish, W.; Miller, W.; Myers, E. W. and Lipman, D. J. (1990) J. Mol. Biol. 215, 403–410), BLAST2 (Altschul, S. F.; Madden, T. L.; Schäffer, A. A.; Zhang, J.; Zhang, Z.; Miller, W., and Lipman, D. J. (1997) Nucleic Acids Research 25 3389–3402) or FASTA (Pearson, W. R. and Lipman, D. J. (1988) Proc. Natl. Acad. Sci. USA 85 2444–2448), the homologous sequences in various EST libraries (private or public) arranged by tissues are determined for a partial DNA sequence S, e.g., an individual EST or a contig of ESTs. The (relative or absolute) tissue-specific occurrence frequencies of this partial sequence S which were determined in this way are called electronic Northern Blots.

2.1.1

Analogously to the procedure described under 2.1, the sequence Seq. ID No. 136 was found, which occurs 15.6× more strongly in the endometrial tumor than in normal tissue.

The result is as follows:

Electronic Northern for SEQ. ID NO.: 136

|  | NORMAL | TUMOR | Ratios | |
| --- | --- | --- | --- | --- |
|  | % frequency | % frequency | N/T | T/N |
| Bladder | 0.0000 | 0.0026 | 0.0000 | undef |
| Breast | 0.0102 | 0.0038 | 2.7221 | 0.3674 |
| Small intestine | 0.0092 | 0.0165 | 0.5561 | 1.7982 |
| Ovary | 0.0090 | 0.0078 | 1.1513 | 0.8686 |
| Endocrine tissue | 0.0000 | 0.0150 | 0.0000 | undef |
| Gastrointestinal | 0.0019 | 0.0093 | 0.2071 | 4.8289 |
| Brain | 0.0059 | 0.0031 | 1.9199 | 0.5209 |
| Hematopoietic | 0.0040 | 0.0379 | 0.1059 | 9.4460 |
| Skin | 0.0073 | 0.0000 | undef | 0.0000 |
| Hepatic | 0.0048 | 0.0065 | 0.7353 | 1.3600 |
| Heart | 0.0000 | 0.0000 | undef | undef |
| Testicles | 0.0000 | 0.0117 | 0.0000 | undef |
| Lung | 0.0114 | 0.0041 | 2.7942 | 0.3579 |
| Stomach-esophagus | 0.0097 | 0.0153 | 0.6303 | 1.5866 |
| Muscle-skeleton | 0.0103 | 0.0120 | 0.8567 | 1.1673 |
| Kidney | 0.0081 | 0.0000 | undef | 0.0000 |
| Pancreas | 0.0050 | 0.0000 | undef | 0.0000 |
| Penis | 0.0060 | 0.0000 | undef | 0.0000 |
| Prostate | 0.0000 | 0.0064 | 0.0000 | undef |
| Uterus-endometrium | 0.0068 | 0.1055 | 0.0640 | 15.6211 |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0030 | | | |
| Seminal vesicle | 0.0000 | | | |
| Sensory organs | 0.0000 | | | |
| White blood cells | 0.0104 | | | |
| Cervix | 0.0000 | | | |

|  | FETUS | STANDARDIZED/SUB-TRACTED LIBRARIES | |
| --- | --- | --- | --- |
|  | % frequency | | % frequency |
| Development | 0.0139 | Breast | 0.0068 |
| Gastrointestinal | 0.0056 | Ovary_n | 0.0000 |
| Brain | 0.0000 | Ovary_t | 0.0000 |
| Hematopoietic | 0.0079 | Endocrine tissue | 0.0000 |
| Skin | 0.0000 | Fetal | 0.0076 |
| Hepatic | 0.0000 | Gastrointestinal | 0.0000 |
| Heart-blood vessels | 0.0142 | Hematopoietic | 0.0171 |
| Lung | 0.0108 | Skin-muscle | 0.0000 |
| Suprarenal gland | 0.0254 | Testicles | 0.0000 |
| Kidney | 0.0000 | Lung | 0.0164 |
| Placenta | 0.0061 | Nerves | 0.0060 |
| Prostate | 0.0000 | Prostate | 0.0068 |
| Sensory organs | 0.0126 | Sensory Organs | 0.0000 |
| | | Uterus_n | 0.0125 |

In an analogous procedure, the following Northerns were also found:

Electronic Northern for SEQ. ID NO.: 1

|  | NORMAL | TUMOR | Ratios | |
| --- | --- | --- | --- | --- |
|  | % frequency | % frequency | N/T | T/N |
| Bladder | 0.0039 | 0.0026 | 1.5254 | 0.6555 |
| Breast | 0.0038 | 0.0056 | 0.6805 | 1.4694 |
| Small intestine | 0.0061 | 0.0000 | undef | 0.0000 |
| Ovary | 0.0030 | 0.0104 | 0.2878 | 3.4745 |
| Endocrine tissue | 0.0017 | 0.0000 | undef | 0.0000 |
| Gastrointestinal | 0.0019 | 0.0000 | undef | 0.0000 |
| Brain | 0.0030 | 0.0031 | 0.9599 | 1.0417 |
| Hematopoietic | 0.0040 | 0.0000 | undef | 0.0000 |
| Skin | 0.0037 | 0.0000 | undef | 0.0000 |
| Hepatic | 0.0000 | 0.0000 | undef | undef |
| Heart | 0.0011 | 0.0000 | undef | 0.0000 |
| Testicles | 0.0000 | 0.0117 | 0.0000 | undef |
| Lung | 0.0031 | 0.0000 | undef | 0.0000 |
| Stomach-esophagus | 0.0000 | 0.0077 | 0.0000 | undef |
| Muscle-skeleton | 0.0000 | 0.0060 | 0.0000 | undef |
| Kidney | 0.0000 | 0.0000 | undef | undef |
| Pancreas | 0.0000 | 0.0000 | undef | undef |

-continued

| | | | |
|---|---|---|---|
| Penis | 0.0000 | 0.0000 | undef | undef |
| Prostate | 0.0022 | 0.0000 | undef | 0.0000 |
| Uterus-endometrium | 0.0068 | 0.1055 | 0.0640 | 15.6211 |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUBTRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0035 |
| Hepatic | 0.0000 | Gastrointestinal | 0.0000 |
| Heart-blood vessels | 0.0036 | Hematopoietic | 0.0000 |
| Lung | 0.0036 | Skin-muscle | 0.0000 |
| Suprarenal gland | 0.0000 | Testicles | 0.0077 |
| Kidney | 0.0000 | Lung | 0.0000 |
| Placenta | 0.0000 | Nerves | 0.0010 |
| Prostate | 0.0000 | Prostate | 0.0000 |
| Sensory organs | 0.0000 | Sensory Organs | 0.0077 |
| | | Uterus_n | 0.0042 |

Electronic Northern for SEQ. ID NO.: 2

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.3166 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUBTRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0122 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |

-continued

| | | | |
|---|---|---|---|
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 3

| | NORMAL | TUMOR | Ratios | |
|---|---|---|---|---|
| | % frequency | % frequency | N/T | T/N |
| Bladder | 0.0078 | 0.0281 | 0.2774 | 3.6055 |
| Breast | 0.0090 | 0.0188 | 0.4764 | 2.0992 |
| Small intestine | 0.0031 | 0.0000 | undef | 0.0000 |
| Ovary | 0.0030 | 0.0052 | 0.5756 | 1.7372 |
| Endocrine tissue | 0.0085 | 0.0176 | 0.4852 | 2.0611 |
| Gastrointestinal | 0.0019 | 0.0093 | 0.2071 | 4.8289 |
| Brain | 0.0118 | 0.0123 | 0.9599 | 1.0417 |
| Hematopoietic | 0.0027 | 0.0000 | undef | 0.0000 |
| Skin | 0.0073 | 0.0000 | undef | 0.0000 |
| Hepatic | 0.0000 | 0.0000 | undef | undef |
| Heart | 0.0042 | 0.0000 | undef | 0.0000 |
| Testicles | 0.0058 | 0.0117 | 0.4920 | 2.0326 |
| Lung | 0.0073 | 0.0020 | 3.5562 | 0.2812 |
| Stomach-esophagus | 0.0097 | 0.0153 | 0.6303 | 1.5866 |
| Muscle-skeleton | 0.0034 | 0.0240 | 0.1428 | 7.0040 |
| Kidney | 0.0136 | 0.0274 | 0.4956 | 2.0176 |
| Pancreas | 0.0050 | 0.0000 | undef | 0.0000 |
| Penis | 0.0090 | 0.0000 | undef | 0.0000 |
| Prostate | 0.0109 | 0.0149 | 0.7312 | 1.3677 |
| Uterus-endometrium | 0.0068 | 0.1583 | 0.0427 | 23.4317 |
| Uterus-myometrium | 0.0076 | 0.0272 | 0.2806 | 3.5642 |
| Uterus-general | 0.0102 | 0.0000 | undef | 0.0000 |
| Breast hyperplasia | 0.0160 | | | |
| Prostate hyperplasia | 0.0119 | | | |
| Seminal vesicle | 0.0178 | | | |
| Sensory organs | 0.0000 | | | |
| White blood cells | 0.0009 | | | |
| Cervix | 0.0000 | | | |

| | FETUS % frequency | STANDARDIZED/SUBTRACTED LIBRARIES % frequency | |
|---|---|---|---|
| Development | 0.0278 | Breast | 0.0272 |
| Gastrointestinal | 0.0194 | Ovary_n | 0.0000 |
| Brain | 0.0063 | Ovary_t | 0.0203 |
| Hematopoietic | 0.0157 | Endocrine tissue | 0.0000 |
| Skin | 0.0000 | Fetal | 0.0076 |
| Hepatic | 0.0000 | Gastrointestinal | 0.0000 |
| Heart-blood vessels | 0.0107 | Hematopoietic | 0.0114 |
| Lung | 0.0145 | Skin-muscle | 0.0194 |
| Suprarenal gland | 0.0254 | Testicles | 0.0000 |
| Kidney | 0.0124 | Lung | 0.0164 |
| Placenta | 0.0121 | Nerves | 0.0120 |
| Prostate | 0.0249 | Prostate | 0.0137 |
| Sensory organs | 0.0000 | Sensory Organs | 0.0155 |
| | | Uterus_n | 0.0083 |

Electronic Northern for SEQ. ID NO.: 4

| | NORMAL | TUMOR | Ratios | |
|---|---|---|---|---|
| | % frequency | % frequency | N/T | T/N |
| Bladder | 0.0039 | 0.0000 | undef | 0.0000 |
| Breast | 0.0026 | 0.0000 | undef | 0.0000 |
| Small intestine | 0.0000 | 0.0165 | 0.0000 | undef |
| Ovary | 0.0030 | 0.0000 | undef | 0.0000 |
| Endocrine tissue | 0.0017 | 0.0000 | undef | 0.0000 |
| Gastrointestinal | 0.0077 | 0.0000 | undef | 0.0000 |
| Brain | 0.0015 | 0.0021 | 0.7200 | 1.3890 |
| Hematopoietic | 0.0000 | 0.0000 | undef | undef |
| Skin | 0.0000 | 0.0000 | undef | undef |
| Hepatic | 0.0048 | 0.0000 | undef | 0.0000 |
| Heart | 0.0011 | 0.0000 | undef | 0.0000 |
| Testicles | 0.0000 | 0.0000 | undef | undef |
| Lung | 0.0021 | 0.0020 | 1.0161 | 0.9842 |

-continued

| | | | |
|---|---|---|---|
| Stomach-esophagus | 0.0193 | 0.0077 | 2.5211 | 0.3967 |
| Muscle-skeleton | 0.0000 | 0.0060 | 0.0000 | undef |
| Kidney | 0.0000 | 0.0000 | undef | undef |
| Pancreas | 0.0017 | 0.0000 | undef | 0.0000 |
| Penis | 0.0030 | 0.0000 | undef | 0.0000 |
| Prostate | 0.0000 | 0.0000 | undef | undef |
| Uterus-endometrium | 0.0000 | 0.1055 | 0.0000 | undef |
| Uterus-myometrium | 0.0076 | 0.0068 | 1.1223 | 0.8911 |
| Uterus-general | 0.0000 | 0.0000 | undef | undef |
| Breast hyperplasia | 0.0000 | | | |
| Prostate hyperplasia | 0.0030 | | | |
| Seminal vesicle | 0.0000 | | | |
| Sensory organs | 0.0000 | | | |
| White blood cells | 0.0017 | | | |
| Cervix | 0.0213 | | | |

| | FETUS % frequency | STANDARDIZED/SUB-TRACTED LIBRARIES % frequency | | |
|---|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0041 |
| Hepatic | 0.0000 | Gastrointestinal | 0.0000 |
| Heart-blood vessels | 0.0036 | Hematopoietic | 0.0000 |
| Lung | 0.0036 | Skin-muscle | 0.0032 |
| Suprarenal gland | 0.0000 | Testicles | 0.0000 |
| Kidney | 0.0000 | Lung | 0.0082 |
| Placenta | 0.0000 | Nerves | 0.0020 |
| Prostate | 0.0000 | Prostate | 0.0000 |
| Sensory organs | 0.0000 | Sensory Organs | 0.0000 |
| | | Uterus_n | 0.0167 |

Electronic Northern for SEQ. ID NO.: 5

| | NORMAL % frequency | TUMOR % frequency | Ratios N/T | Ratios T/N |
|---|---|---|---|---|
| Bladder | 0.0039 | 0.0026 | 1.5254 | 0.6555 |
| Breast | 0.0038 | 0.0038 | 1.0208 | 0.9796 |
| Small intestine | 0.0031 | 0.0000 | undef | 0.0000 |
| Ovary | 0.0060 | 0.0000 | undef | 0.0000 |
| Endocrine tissue | 0.0000 | 0.0025 | 0.0000 | undef |
| Gastrointestinal | 0.0000 | 0.0093 | 0.0000 | undef |
| Brain | 0.0015 | 0.0021 | 0.7200 | 1.3890 |
| Hematopoietic | 0.0053 | 0.0000 | undef | 0.0000 |
| Skin | 0.0000 | 0.0000 | undef | undef |
| Hepatic | 0.0000 | 0.0000 | undef | undef |
| Heart | 0.0053 | 0.0137 | 0.3855 | 2.5941 |
| Testicles | 0.0000 | 0.0000 | undef | undef |
| Lung | 0.0000 | 0.0000 | undef | undef |
| Stomach-esophagus | 0.0193 | 0.0000 | undef | 0.0000 |
| Muscle-skeleton | 0.0017 | 0.0000 | undef | 0.0000 |
| Kidney | 0.0000 | 0.0000 | undef | undef |
| Pancreas | 0.0017 | 0.0055 | 0.2991 | 3.3428 |
| Penis | 0.0060 | 0.0267 | 0.2246 | 4.4517 |
| Prostate | 0.0065 | 0.0021 | 3.0709 | 0.3256 |
| Uterus-endometrium | 0.0135 | 0.1055 | 0.1280 | 7.8106 |
| Uterus-myometrium | 0.0000 | 0.0068 | 0.0000 | undef |
| Uterus-general | 0.0051 | 0.0000 | undef | 0.0000 |
| Breast hyperplasia | 0.0096 | | | |
| Prostate hyperplasia | 0.0000 | | | |
| Seminal vesicle | 0.0178 | | | |
| Sensory organs | 0.0000 | | | |
| White blood cells | 0.0078 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0083 | Ovary_n | 0.0000 |
| Brain | 0.0000 | Ovary_t | 0.0759 |
| Hematopoietic | 0.0079 | Endocrine tissue | 0.0000 |
| Skin | 0.0000 | Fetal | 0.0029 |
| Hepatic | 0.0000 | Gastrointestinal | 0.0122 |
| Heart-blood vessels | 0.0000 | Hematopoietic | 0.0057 |
| Lung | 0.0036 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0040 |
| Prostate | 0.0000 | Prostate | 0.0000 |
| Sensory organs | 0.0000 | Sensory Organs | 0.0000 |
| | | Uterus_n | 0.0083 |

Electronic Northern for SEQ. ID NO.: 6

| | NORMAL % frequency | TUMOR % frequency | Ratios N/T | Ratios T/N |
|---|---|---|---|---|
| Bladder | 0.0156 | 0.0077 | 2.0339 | 0.4917 |
| Breast | 0.0051 | 0.0075 | 0.6805 | 1.4694 |
| Small intestine | 0.0123 | 0.0331 | 0.3707 | 2.6973 |
| Ovary | 0.0120 | 0.0104 | 1.1513 | 0.8686 |
| Endocrine tissue | 0.0085 | 0.0075 | 1.1321 | 0.8833 |
| Gastrointestinal | 0.0096 | 0.0278 | 0.3451 | 2.8974 |
| Brain | 0.0133 | 0.0164 | 0.8100 | 1.2346 |
| Hematopoietic | 0.0120 | 0.0000 | undef | 0.0000 |
| Skin | 0.0073 | 0.0000 | undef | 0.0000 |
| Hepatic | 0.0000 | 0.0000 | undef | undef |
| Heart | 0.0170 | 0.0000 | undef | 0.0000 |
| Testicles | 0.0058 | 0.0117 | 0.4920 | 2.0326 |
| Lung | 0.0197 | 0.0164 | 1.2066 | 0.8288 |
| Stomach-esophagus | 0.0193 | 0.0000 | undef | 0.0000 |
| Muscle-skeleton | 0.0034 | 0.0180 | 0.1904 | 5.2530 |
| Kidney | 0.0054 | 0.0274 | 0.1983 | 5.0439 |
| Pancreas | 0.0066 | 0.0055 | 1.1966 | 0.8357 |
| Penis | 0.0240 | 0.0267 | 0.8985 | 1.1129 |
| Prostate | 0.0044 | 0.0192 | 0.2275 | 4.3961 |
| Uterus-endometrium | 0.0000 | 0.1055 | 0.0000 | undef |
| Uterus-myometrium | 0.0229 | 0.0272 | 0.8417 | 1.1881 |
| Uterus-general | 0.0102 | 0.0000 | undef | 0.0000 |
| Breast hyperplasia | 0.0192 | | | |
| Prostate hyperplasia | 0.0059 | | | |
| Seminal vesicle | 0.0089 | | | |
| Sensory organs | 0.0000 | | | |
| White blood cells | 0.0104 | | | |
| Cervix | 0.0106 | | | |

| | FETUS % frequency | STANDARDIZED/SUB-TRACTED LIBRARIES % frequency | |
|---|---|---|---|
| Development | 0.0139 | Breast | 0.0136 |
| Gastrointestinal | 0.0250 | Ovary_n | 0.0000 |
| Brain | 0.0063 | Ovary_t | 0.0354 |
| Hematopoietic | 0.0157 | Endocrine tissue | 0.0000 |
| Skin | 0.0000 | Fetal | 0.0245 |
| Hepatic | 0.0260 | Gastrointestinal | 0.0244 |
| Heart-blood vessels | 0.0178 | Hematopoietic | 0.0228 |
| Lung | 0.0036 | Skin-muscle | 0.0551 |
| Suprarenal gland | 0.0000 | Testicles | 0.0386 |
| Kidney | 0.0000 | Lung | 0.0082 |
| Placenta | 0.0121 | Nerves | 0.0181 |
| Prostate | 0.0000 | Prostate | 0.0068 |
| Sensory organs | 0.0251 | Sensory Organs | 0.0000 |
| | | Uterus_n | 0.0167 |

Electronic Northern for SEQ. ID NO.: 7

| | NORMAL % frequency | TUMOR % frequency | Ratios N/T | Ratios T/N |
|---|---|---|---|---|
| Bladder | 0.0000 | 0.0000 | undef | undef |
| Breast | 0.0026 | 0.0019 | 1.3611 | 0.7347 |
| Small intestine | 0.0061 | 0.0000 | undef | 0.0000 |
| Ovary | 0.0060 | 0.0026 | 2.3025 | 0.4343 |
| Endocrine tissue | 0.0051 | 0.0000 | undef | 0.0000 |
| Gastrointestinal | 0.0096 | 0.0139 | 0.6903 | 1.4487 |
| Brain | 0.0037 | 0.0092 | 0.4000 | 2.5001 |
| Hematopoietic | 0.0013 | 0.0000 | undef | 0.0000 |
| Skin | 0.0000 | 0.0000 | undef | undef |

-continued

| | | | | |
|---|---|---|---|---|
| Hepatic | 0.0000 | 0.0000 | undef | undef |
| Heart | 0.0042 | 0.0000 | undef | 0.0000 |
| Testicles | 0.0000 | 0.0000 | undef | undef |
| Lung | 0.0042 | 0.0041 | 1.0161 | 0.9842 |
| Stomach-esophagus | 0.0097 | 0.0153 | 0.6303 | 1.5866 |
| Muscle-skeleton | 0.0000 | 0.0120 | 0.0000 | undef |
| Kidney | 0.0027 | 0.0000 | undef | 0.0000 |
| Pancreas | 0.0017 | 0.0000 | undef | 0.0000 |
| Penis | 0.0150 | 0.0000 | undef | 0.0000 |
| Prostate | 0.0087 | 0.0043 | 2.0473 | 0.4885 |
| Uterus-endometrium | 0.0068 | 0.1055 | 0.0640 | 15.6211 |
| Uterus-myometrium | 0.0076 | 0.0000 | undef | 0.0000 |
| Uterus-general | 0.0000 | 0.0000 | undef | undef |
| Breast hyperplasia | 0.0032 | | | |
| Prostate hyperplasia | 0.0000 | | | |
| Seminal vesicle | 0.0089 | | | |
| Sensory organs | 0.0000 | | | |
| White blood cells | 0.0000 | | | |
| Cervix | 0.0000 | | | |

| | FETUS % frequency | STANDARDIZED/SUB- TRACTED LIBRARIES % frequency |
|---|---|---|
| Development | 0.0000 | Breast | 0.0000 |
| Gastrointestinal | 0.0000 | Ovary_n | 0.1595 |
| Brain | 0.0000 | Ovary_t | 0.0000 |
| Hematopoietic | 0.0000 | Endocrine tissue | 0.0000 |
| Skin | 0.0000 | Fetal | 0.0082 |
| Hepatic | 0.0000 | Gastrointestinal | 0.0000 |
| Heart-blood vessels | 0.0036 | Hematopoietic | 0.0000 |
| Lung | 0.0000 | Skin-muscle | 0.0097 |
| Suprarenal gland | 0.0000 | Testicles | 0.0000 |
| Kidney | 0.0062 | Lung | 0.0000 |
| Placenta | 0.0000 | Nerves | 0.0000 |
| Prostate | 0.0000 | Prostate | 0.0000 |
| Sensory organs | 0.0126 | Sensory Organs | 0.0155 |
| | | Uterus_n | 0.0000 |

Electronic Northern for SEQ. ID NO.: 8

| | NORMAL % frequency | TUMOR % frequency | Ratios N/T | Ratios T/N |
|---|---|---|---|---|
| Bladder | 0.0000 | 0.0026 | 0.0000 | undef |
| Breast | 0.0000 | 0.0019 | 0.0000 | undef |
| Small intestine | 0.0031 | 0.0000 | undef | 0.0000 |
| Ovary | 0.0000 | 0.0000 | undef | undef |
| Endocrine tissue | 0.0000 | 0.0025 | 0.0000 | undef |
| Gastrointestinal | 0.0019 | 0.0046 | 0.4142 | 2.4145 |
| Brain | 0.0000 | 0.0021 | 0.0000 | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0021 | 0.0000 | undef | 0.0000 |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0034 | 0.0000 | undef | 0.0000 |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0022 | 0.0000 | undef | 0.0000 |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0118 | | | |
| White blood cells | 0.0009 | | | |
| Cervix | 0.0000 | | | |

| | FETUS % frequency | STANDARDIZED/SUB- TRACTED LIBRARIES % frequency |
|---|---|---|
| Development | 0.0000 | Breast | 0.0068 |
| Gastrointestinal | 0.0000 | Ovary_n | 0.0000 |
| Brain | 0.0000 | Ovary_t | 0.0203 |
| Hematopoietic | 0.0079 | Endocrine tissue | 0.0000 |
| Skin | 0.0000 | Fetal | 0.0047 |
| Hepatic | 0.0000 | Gastrointestinal | 0.0000 |
| Heart-blood vessels | 0.0000 | Hematopoietic | 0.0057 |
| Lung | 0.0108 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0050 |
| Prostate | 0.0000 | Prostate | 0.0137 |
| Sensory organs | 0.0000 | Sensory Organs | 0.0000 |
| | | Uterus_n | 0.0000 |

Electronic Northern for SEQ. ID NO.: 9

| | NORMAL % frequency | TUMOR % frequency | Ratios N/T | Ratios T/N |
|---|---|---|---|---|
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0019 | 0.0000 | undef | 0.0000 |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB- TRACTED LIBRARIES % frequency |
|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0006 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

-continued

Electronic Northern for SEQ. ID NO.: 10

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1583 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 11

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0090 | 0.0188 | 0.4764 | 2.0992 |
| Small intestine | 0.0153 | 0.0000 | undef | 0.0000 |
| Ovary | 0.0000 | 0.0000 | undef | undef |
| Endocrine tissue | 0.0051 | 0.0050 | 1.0189 | 0.9815 |
| Gastrointestinal | 0.0038 | 0.0000 | undef | 0.0000 |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0115 | 0.0117 | 0.9839 | 1.0163 |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0066 | 0.0055 | 1.1966 | 0.8357 |
| Penis | 0.0000 | 0.0000 | undef | undef |
| Prostate | 0.0131 | 0.0213 | 0.6142 | 1.6282 |
| Uterus-endometrium | 0.0000 | 0.1583 | 0.0000 | undef |
| Uterus-myometrium | 0.0000 | 0.0000 | undef | undef |
| Uterus-general | 0.0000 | 0.0000 | undef | undef |
| Breast hyperplasia | 0.0032 | | | |
| Prostate hyperplasia | 0.0178 | | | |
| Seminal vesicle | 0.0000 | | | |
| Sensory organs | 0.0000 | | | |
| White blood cells | 0.0017 | | | |
| Cervix | 0.0106 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0028 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0154 |
| Kidney | 0.0000 | Lung | 0.0000 |
| Placenta | 0.0000 | Nerves | 0.0000 |
| Prostate | 0.0000 | Prostate | 0.0342 |
| Sensory organs | 0.0000 | Sensory Organs | 0.0000 |
| | | Uterus_n | 0.0000 |

Electronic Northern for SEQ. ID NO.: 12

| | NORMAL | TUMOR | Ratios | |
|---|---|---|---|---|
| | % frequency | % frequency | N/T | T/N |
| Bladder | 0.0000 | 0.0026 | 0.0000 | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0019 | 0.0000 | undef | 0.0000 |
| Brain | 0.0007 | 0.0000 | undef | 0.0000 |
| Hematopoietic | 0.0000 | 0.0000 | undef | undef |
| Skin | 0.0037 | 0.0000 | undef | 0.0000 |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0021 | 0.0000 | undef | 0.0000 |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0051 |
| Hematopoietic | 0.0000 | Endocrine tissue | 0.0000 |
| Skin | 0.0000 | Fetal | 0.0035 |
| Hepatic | 0.0000 | Gastrointestinal | 0.0000 |
| Heart-blood vessels | 0.0000 | Hematopoietic | 0.0057 |
| Lung | 0.0072 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0030 |

| | | | | |
|---|---|---|---|---|
| Prostate | 0.0000 | Prostate | 0.0000 | |
| Sensory organs | 0.0000 | Sensory Organs | 0.0000 | |
| | | Uterus_n | 0.0000 | |

Electronic Northern for SEQ. ID NO.: 13

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0038 | 0.0019 | 2.0416 | 0.4898 |
| Small intestine | 0.0061 | 0.0000 | undef | 0.0000 |
| Ovary | 0.0000 | 0.0208 | 0.0000 | undef |
| Endocrine tissue | 0.0034 | 0.0201 | 0.1698 | 5.8889 |
| Gastrointestinal | 0.0057 | 0.0000 | undef | 0.0000 |
| Brain | 0.0081 | 0.0072 | 1.1314 | 0.8839 |
| Hematopoietic | 0.0000 | 0.0000 | undef | undef |
| Skin | 0.0037 | 0.0000 | undef | 0.0000 |
| Hepatic | 0.0000 | 0.0000 | undef | undef |
| Heart | 0.0021 | 0.0000 | undef | 0.0000 |
| Testicles | 0.0058 | 0.0000 | undef | 0.0000 |
| Lung | 0.0010 | 0.0020 | 0.5080 | 1.9684 |
| Stomach-esophagus | 0.0000 | 0.0000 | undef | undef |
| Muscle-skeleton | 0.0051 | 0.0000 | undef | 0.0000 |
| Kidney | 0.0054 | 0.0000 | undef | 0.0000 |
| Pancreas | 0.0017 | 0.0000 | undef | 0.0000 |
| Penis | 0.0030 | 0.0000 | undef | 0.0000 |
| Prostate | 0.0065 | 0.0043 | 1.5354 | 0.6513 |
| Uterus-endometrium | 0.0068 | 0.1583 | 0.0427 | 23.4317 |
| Uterus-myometrium | 0.0152 | 0.0000 | undef | 0.0000 |
| Uterus-general | 0.0051 | 0.0000 | undef | 0.0000 |
| Breast hyperplasia | 0.0096 | | | |
| Prostate hyperplasia | 0.0149 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | | |
|---|---|---|---|---|
| Development | 0.0000 | Breast | 0.0000 | |
| Gastrointestinal | 0.0028 | Ovary_n | 0.0000 | |
| Brain | 0.0000 | Ovary_t | 0.0000 | |
| Hematopoietic | 0.0039 | Endocrine tissue | 0.0000 | |
| Skin | 0.0000 | Fetal | 0.0093 | |
| Hepatic | 0.0000 | Gastrointestinal | 0.0000 | |
| Heart-blood vessels | 0.0036 | Hematopoietic | 0.0057 | |
| Lung | 0.0036 | Skin-muscle | 0.0032 | |
| Suprarenal gland | 0.0000 | Testicles | 0.0309 | |
| Kidney | 0.0062 | Lung | 0.0000 | |
| Placenta | 0.0000 | Nerves | 0.0100 | |
| Prostate | 0.0000 | Prostate | 0.0000 | |
| Sensory organs | 0.0000 | Sensory Organs | 0.0077 | |
| | | Uterus_n | 0.0250 | |

Electronic Northern for SEQ. ID NO.: 14

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0030 | 0.0000 | undef | 0.0000 |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0054 | 0.0000 | undef | 0.0000 |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 15

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |

-continued

| | | |
|---|---|---|
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 16

| | NORMAL | TUMOR | Ratios | |
|---|---|---|---|---|
| | % frequency | % frequency | N/T | T/N |
| Bladder | 0.0078 | 0.0128 | 0.6102 | 1.6389 |
| Breast | 0.0153 | 0.0188 | 0.8166 | 1.2245 |
| Small intestine | 0.0184 | 0.0000 | undef | 0.0000 |
| Ovary | 0.0090 | 0.0182 | 0.4934 | 2.0268 |
| Endocrine tissue | 0.0187 | 0.0100 | 1.8679 | 0.5354 |
| Gastrointestinal | 0.0192 | 0.0324 | 0.5917 | 1.6901 |
| Brain | 0.0067 | 0.0205 | 0.3240 | 3.0866 |
| Hematopoietic | 0.0147 | 0.0379 | 0.3882 | 2.5762 |
| Skin | 0.0073 | 0.0000 | undef | 0.0000 |
| Hepatic | 0.0143 | 0.0323 | 0.4412 | 2.2666 |
| Heart | 0.0148 | 0.0275 | 0.5397 | 1.8529 |
| Testicles | 0.0115 | 0.0000 | undef | 0.0000 |
| Lung | 0.0156 | 0.0102 | 1.5241 | 0.6561 |
| Stomach-esophagus | 0.0290 | 0.0307 | 0.9454 | 1.0578 |
| Muscle-skeleton | 0.0154 | 0.0120 | 1.2850 | 0.7782 |
| Kidney | 0.0407 | 0.0068 | 5.9478 | 0.1681 |
| Pancreas | 0.0132 | 0.0110 | 1.1966 | 0.8357 |
| Penis | 0.0120 | 0.0267 | 0.4493 | 2.2259 |
| Prostate | 0.0153 | 0.0085 | 1.7913 | 0.5582 |
| Uterus-endometrium | 0.0000 | 0.1055 | 0.0000 | undef |
| Uterus-myometrium | 0.0229 | 0.0068 | 3.3668 | 0.2970 |
| Uterus-general | 0.0153 | 0.0000 | undef | 0.0000 |
| Breast hyperplasia | 0.0192 | | | |
| Prostate hyperplasia | 0.0059 | | | |
| Seminal vesicle | 0.0178 | | | |
| Sensory organs | 0.0353 | | | |
| White blood cells | 0.0165 | | | |
| Cervix | 0.0319 | | | |

| | FETUS | STANDARDIZED/SUB-TRACTED LIBRARIES | |
|---|---|---|---|
| | % frequency | | % frequency |
| Development | 0.0278 | Breast | 0.0476 |
| Gastrointestinal | 0.0056 | Ovary_n | 0.0000 |
| Brain | 0.0000 | Ovary_t | 0.1114 |
| Hematopoietic | 0.0393 | Endocrine tissue | 0.0245 |
| Skin | 0.0000 | Fetal | 0.0175 |
| Hepatic | 0.0000 | Gastrointestinal | 0.0244 |
| Heart-blood vessels | 0.0000 | Hematopoietic | 0.0114 |
| Lung | 0.0072 | Skin-muscle | 0.0292 |
| Suprarenal gland | 0.0000 | Testicles | 0.0000 |
| Kidney | 0.0124 | Lung | 0.0082 |
| Placenta | 0.0061 | Nerves | 0.0020 |
| Prostate | 0.0249 | Prostate | 0.0000 |
| Sensory organs | 0.0000 | Sensory Organs | 0.0310 |
| | | Uterus_n | 0.0167 |

Electronic Northern for SEQ. ID NO.: 17

| | NORMAL | TUMOR | Ratios | |
|---|---|---|---|---|
| | % frequency | % frequency | N/T | T/N |
| Bladder | 0.0039 | 0.0026 | 1.5254 | 0.6555 |
| Breast | 0.0051 | 0.0000 | undef | 0.0000 |
| Small intestine | 0.0031 | 0.0000 | undef | 0.0000 |
| Ovary | 0.0030 | 0.0000 | undef | 0.0000 |
| Endocrine tissue | 0.0017 | 0.0025 | 0.6792 | 1.4722 |
| Gastrointestinal | 0.0000 | 0.0046 | 0.0000 | undef |
| Brain | 0.0111 | 0.0031 | 3.5998 | 0.2778 |
| Hematopoietic | 0.0000 | 0.0000 | undef | undef |
| Skin | 0.0037 | 0.0000 | undef | 0.0000 |
| Hepatic | 0.0000 | 0.0129 | 0.0000 | undef |
| Heart | 0.0011 | 0.0000 | undef | 0.0000 |
| Testicles | 0.0000 | 0.0000 | undef | undef |
| Lung | 0.0031 | 0.0041 | 0.7621 | 1.3122 |
| Stomach-esophagus | 0.0000 | 0.0000 | undef | undef |
| Muscle-skeleton | 0.0034 | 0.0060 | 0.5711 | 1.7510 |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0022 | 0.0000 | undef | 0.0000 |
| Uterus-endometrium | 0.0000 | 0.1055 | 0.0000 | undef |
| Uterus-myometrium | 0.0076 | 0.0000 | undef | 0.0000 |
| Uterus-general | 0.0000 | 0.0000 | undef | undef |
| Breast hyperplasia | 0.0096 | | | |
| Prostate hyperplasia | 0.0000 | | | |
| Seminal vesicle | 0.0000 | | | |
| Sensory organs | 0.0000 | | | |
| White blood cells | 0.0035 | | | |
| Cervix | 0.0000 | | | |

| | FETUS | STANDARDIZED/SUB-TRACTED LIBRARIES | |
|---|---|---|---|
| | % frequency | | % frequency |
| Development | 0.0000 | Breast | 0.0000 |
| Gastrointestinal | 0.0028 | Ovary_n | 0.0000 |
| Brain | 0.0000 | Ovary_t | 0.0000 |
| Hematopoietic | 0.0079 | Endocrine tissue | 0.0000 |
| Skin | 0.0000 | Fetal | 0.0070 |
| Hepatic | 0.0000 | Gastrointestinal | 0.0000 |
| Heart-blood vessels | 0.0036 | Hematopoietic | 0.0000 |
| Lung | 0.0036 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0100 |
| Prostate | 0.0000 | Prostate | 0.0000 |
| Sensory organs | 0.0000 | Sensory Organs | 0.0000 |
| | | Uterus_n | 0.0208 |

Electronic Northern for SEQ. ID NO.: 18

| | NORMAL | TUMOR | Ratios | |
|---|---|---|---|---|
| | % frequency | % frequency | N/T | T/N |
| Bladder | 0.0078 | 0.0256 | 0.3051 | 3.2777 |
| Breast | 0.0090 | 0.0113 | 0.7939 | 1.2595 |
| Small intestine | 0.0092 | 0.0000 | undef | 0.0000 |
| Ovary | 0.0090 | 0.0286 | 0.3140 | 3.1849 |
| Endocrine tissue | 0.0255 | 0.0050 | 5.0944 | 0.1963 |
| Gastrointestinal | 0.0096 | 0.0185 | 0.5177 | 1.9316 |
| Brain | 0.0044 | 0.0082 | 0.5400 | 1.8520 |
| Hematopoietic | 0.0134 | 0.0379 | 0.3529 | 2.8338 |
| Skin | 0.0073 | 0.0000 | undef | 0.0000 |
| Hepatic | 0.0285 | 0.0194 | 1.4706 | 0.6800 |
| Heart | 0.0042 | 0.0275 | 0.1542 | 6.4853 |
| Testicles | 0.0000 | 0.0117 | 0.0000 | undef |
| Lung | 0.0083 | 0.0184 | 0.4516 | 2.2144 |
| Stomach-esophagus | 0.0000 | 0.0077 | 0.0000 | undef |
| Muscle-skeleton | 0.0000 | 0.0060 | 0.0000 | undef |
| Kidney | 0.0109 | 0.0274 | 0.3965 | 2.5219 |
| Pancreas | 0.0017 | 0.0110 | 0.1496 | 6.6857 |
| Penis | 0.0060 | 0.0533 | 0.1123 | 8.9035 |
| Prostate | 0.0262 | 0.0192 | 1.3648 | 0.7327 |
| Uterus-endometrium | 0.0068 | 0.1583 | 0.0427 | 23.4317 |
| Uterus-myometrium | 0.0000 | 0.0068 | 0.0000 | undef |
| Uterus-general | 0.0000 | 0.0000 | undef | undef |
| Breast hyperplasia | 0.0128 | | | |
| Prostate hyperplasia | 0.0297 | | | |
| Seminal vesicle | 0.0356 | | | |
| Sensory organs | 0.0000 | | | |
| White blood cells | 0.0113 | | | |
| Cervix | 0.0000 | | | |

| | FETUS | STANDARDIZED/SUB-TRACTED LIBRARIES | |
|---|---|---|---|
| | % frequency | | % frequency |
| Development | 0.0278 | Breast | 0.0028 |
| Gastrointestinal | 0.0028 | Ovary_n | 0.0000 |
| Brain | 0.0188 | Ovary_t | 0.0152 |

-continued

| | | | |
|---|---|---|---|
| Hematopoietic | 0.0039 | Endocrine tissue | 0.0245 |
| Skin | 0.0000 | Fetal | 0.0064 |
| Hepatic | 0.0000 | Gastrointestinal | 0.0244 |
| Heart-blood vessels | 0.0107 | Hematopoietic | 0.0057 |
| Lung | 0.0000 | Skin-muscle | 0.0389 |
| Suprarenal gland | 0.0000 | Testicles | 0.0077 |
| Kidney | 0.0124 | Lung | 0.0000 |
| Placenta | 0.0182 | Nerves | 0.0080 |
| Prostate | 0.0000 | Prostate | 0.0274 |
| Sensory organs | 0.0126 | Sensory Organs | 0.0000 |
| | | Uterus_n | 0.0458 |

Electronic Northern for SEQ. ID NO.: 19

| | NORMAL | TUMOR | Ratios | |
|---|---|---|---|---|
| | % frequency | % frequency | N/T | T/N |
| Bladder | 0.0195 | 0.0102 | 1.9068 | 0.5244 |
| Breast | 0.0115 | 0.0132 | 0.8750 | 1.1429 |
| Small intestine | 0.0123 | 0.0165 | 0.7415 | 1.3487 |
| Ovary | 0.0060 | 0.0078 | 0.7675 | 1.3029 |
| Endocrine tissue | 0.0119 | 0.0125 | 0.9509 | 1.0516 |
| Gastrointestinal | 0.0096 | 0.0139 | 0.6903 | 1.4487 |
| Brain | 0.0096 | 0.0041 | 2.3399 | 0.4274 |
| Hematopoietic | 0.0080 | 0.0379 | 0.2117 | 4.7230 |
| Skin | 0.0330 | 0.2542 | 0.1300 | 7.6946 |
| Hepatic | 0.0048 | 0.0000 | undef | 0.0000 |
| Heart | 0.0127 | 0.0000 | undef | 0.0000 |
| Testicles | 0.0115 | 0.0468 | 0.2460 | 4.0652 |
| Lung | 0.0052 | 0.0082 | 0.6350 | 1.5747 |
| Stomach-esophagus | 0.0000 | 0.0153 | 0.0000 | undef |
| Muscle-skeleton | 0.0086 | 0.0060 | 1.4278 | 0.7004 |
| Kidney | 0.0081 | 0.0000 | undef | 0.0000 |
| Pancreas | 0.0050 | 0.0055 | 0.8974 | 1.1143 |
| Penis | 0.0150 | 0.0267 | 0.5616 | 1.7807 |
| Prostate | 0.0087 | 0.0106 | 0.8189 | 1.2211 |
| Uterus-endometrium | 0.0000 | 0.1055 | 0.0000 | undef |
| Uterus-myometrium | 0.0000 | 0.0000 | undef | undef |
| Uterus-general | 0.0458 | 0.0000 | undef | 0.0000 |
| Breast hyperplasia | 0.0384 | | | |
| Prostate hyperplasia | 0.0030 | | | |
| Seminal vesicle | 0.0000 | | | |
| Sensory organs | 0.0353 | | | |
| White blood cells | 0.0113 | | | |
| Cervix | 0.0000 | | | |

| | FETUS | STANDARDIZED/SUB-TRACTED LIBRARIES |
|---|---|---|
| | % frequency | % frequency |
| Development | 0.0139 | Breast 0.0136 |
| Gastrointestinal | 0.0056 | Ovary_n 0.0000 |
| Brain | 0.0000 | Ovary_t 0.0000 |
| Hematopoietic | 0.0000 | Endocrine tissue 0.0000 |
| Skin | 0.0000 | Fetal 0.0070 |
| Hepatic | 0.0000 | Gastrointestinal 0.0122 |
| Heart-blood vessels | 0.0036 | Hematopoietic 0.0000 |
| Lung | 0.0000 | Skin-muscle 0.0065 |
| Suprarenal gland | 0.0000 | Testicles 0.0077 |
| Kidney | 0.0000 | Lung 0.0000 |
| Placenta | 0.0121 | Nerves 0.0040 |
| Prostate | 0.0000 | Prostate 0.0000 |
| Sensory organs | 0.0000 | Sensory Organs 0.0077 |
| | | Uterus_n 0.0000 |

Electronic Northern for SEQ. ID NO.: 20

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0027 | 0.0000 | undef | 0.0000 |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.2111 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS | STANDARDIZED/SUB-TRACTED LIBRARIES |
|---|---|---|
| | % frequency | % frequency |
| Development | 0.0000 | Breast 0.0000 |
| Gastrointestinal | 0.0000 | Ovary_n 0.0000 |
| Brain | 0.0000 | Ovary_t 0.0000 |
| Hematopoietic | 0.0000 | Endocrine tissue 0.0000 |
| Skin | 0.0000 | Fetal 0.0000 |
| Hepatic | 0.0000 | Gastrointestinal 0.0000 |
| Heart-blood vessels | 0.0000 | Hematopoietic 0.0000 |
| Lung | 0.0000 | Skin-muscle 0.0000 |
| Suprarenal gland | 0.0000 | Testicles 0.0000 |
| Kidney | 0.0000 | Lung 0.0000 |
| Placenta | 0.0000 | Nerves 0.0000 |
| Prostate | 0.0000 | Prostate 0.0000 |
| Sensory organs | 0.0000 | Sensory Organs 0.0000 |
| | | Uterus_n 0.0000 |

Electronic Northern for SEQ. ID NO.: 21

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0009 | | | |
| Cervix | 0.0000 | | | |

|  | FETUS % frequency | STANDARDIZED/SUBTRACTED LIBRARIES % frequency |
|---|---|---|
| Development | 0.0000 | Breast 0.0000 |
| Gastrointestinal | 0.0000 | Ovary_n 0.0000 |
| Brain | 0.0000 | Ovary_t 0.0000 |
| Hematopoietic | 0.0000 | Endocrine tissue 0.0000 |
| Skin | 0.0000 | Fetal 0.0000 |
| Hepatic | 0.0000 | Gastrointestinal 0.0000 |
| Heart-blood vessels | 0.0000 | Hematopoietic 0.0000 |
| Lung | 0.0000 | Skin-muscle 0.0000 |
| Suprarenal gland | 0.0000 | Testicles 0.0000 |
| Kidney | 0.0000 | Lung 0.0000 |
| Placenta | 0.0000 | Nerves 0.0000 |
| Prostate | 0.0000 | Prostate 0.0000 |
| Sensory organs | 0.0000 | Sensory Organs 0.0000 |
|  |  | Uterus_n 0.0000 |

Electronic Northern for SEQ. ID NO.: 22

|  | NORMAL % frequency | TUMOR % frequency | Ratios N/T | Ratios T/N |
|---|---|---|---|---|
| Bladder | 0.0000 | 0.0128 | 0.0000 | undef |
| Breast | 0.0051 | 0.0075 | 0.6805 | 1.4694 |
| Small intestine | 0.0123 | 0.0000 | undef | 0.0000 |
| Ovary | 0.0060 | 0.0104 | 0.5756 | 1.7372 |
| Endocrine tissue | 0.0102 | 0.0125 | 0.8151 | 1.2268 |
| Gastrointestinal | 0.0172 | 0.0093 | 1.8638 | 0.5365 |
| Brain | 0.0052 | 0.0010 | 5.0397 | 0.1984 |
| Hematopoietic | 0.0027 | 0.0000 | undef | 0.0000 |
| Skin | 0.0000 | 0.0000 | undef | undef |
| Hepatic | 0.0000 | 0.0065 | 0.0000 | undef |
| Heart | 0.0201 | 0.0412 | 0.4883 | 2.0480 |
| Testicles | 0.0288 | 0.0234 | 1.2299 | 0.8130 |
| Lung | 0.0114 | 0.0184 | 0.6209 | 1.6105 |
| Stomach-esophagus | 0.0097 | 0.0077 | 1.2605 | 0.7933 |
| Muscle-skeleton | 0.0086 | 0.0180 | 0.4759 | 2.1012 |
| Kidney | 0.0217 | 0.0000 | undef | 0.0000 |
| Pancreas | 0.0149 | 0.0221 | 0.6731 | 1.4857 |
| Penis | 0.0150 | 0.0000 | undef | 0.0000 |
| Prostate | 0.0065 | 0.0170 | 0.3839 | 2.6051 |
| Uterus-endometrium | 0.0000 | 0.1055 | 0.0000 | undef |
| Uterus-myometrium | 0.0000 | 0.0068 | 0.0000 | undef |
| Uterus-general | 0.0000 | 0.0000 | undef | undef |
| Breast hyperplasia | 0.0192 |  |  |  |
| Prostate hyperplasia | 0.0149 |  |  |  |
| Seminal vesicle | 0.0000 |  |  |  |
| Sensory organs | 0.0118 |  |  |  |
| White blood cells | 0.0130 |  |  |  |
| Cervix | 0.0000 |  |  |  |

|  | FETUS % frequency | STANDARDIZED/SUBTRACTED LIBRARIES % frequency |
|---|---|---|
| Development | 0.0139 | Breast 0.0000 |
| Gastrointestinal | 0.0111 | Ovary_n 0.0000 |
| Brain | 0.0000 | Ovary_t 0.0203 |
| Hematopoietic | 0.0000 | Endocrine tissue 0.0000 |
| Skin | 0.0000 | Fetal 0.0052 |
| Hepatic | 0.0000 | Gastrointestinal 0.0244 |
| Heart-blood vessels | 0.0071 | Hematopoietic 0.0057 |
| Lung | 0.0072 | Skin-muscle 0.0227 |
| Suprarenal gland | 0.0000 | Testicles 0.0154 |
| Kidney | 0.0000 | Lung 0.0164 |
| Placenta | 0.0061 | Nerves 0.0030 |
| Prostate | 0.0249 | Prostate 0.0205 |
| Sensory organs | 0.0000 | Sensory Organs 0.0000 |
|  |  | Uterus_n 0.0125 |

Electronic Northern for SEQ. ID NO.: 23

|  | NORMAL % frequency | TUMOR % frequency | Ratios N/T | Ratios T/N |
|---|---|---|---|---|
| Bladder | 0.0078 | 0.0026 | 3.0509 | 0.3278 |
| Breast | 0.0026 | 0.0000 | undef | 0.0000 |
| Small intestine | 0.0184 | 0.0000 | undef | 0.0000 |
| Ovary | 0.0000 | 0.0026 | 0.0000 | undef |
| Endocrine tissue | 0.0017 | 0.0000 | undef | 0.0000 |
| Gastrointestinal | 0.0000 | 0.0000 | undef | undef |
| Brain | 0.0007 | 0.0041 | 0.1800 | 5.5559 |
| Hematopoietic | 0.0000 | 0.0000 | undef | undef |
| Skin | 0.0073 | 0.0000 | undef | 0.0000 |
| Hepatic | 0.0000 | 0.0000 | undef | undef |
| Heart | 0.0032 | 0.0137 | 0.2313 | 4.3235 |
| Testicles | 0.0000 | 0.0117 | 0.0000 | undef |
| Lung | 0.0021 | 0.0020 | 1.0161 | 0.9842 |
| Stomach-esophagus | 0.0097 | 0.0000 | undef | 0.0000 |
| Muscle-skeleton | 0.0000 | 0.0060 | 0.0000 | undef |
| Kidney | 0.0000 | 0.0205 | 0.0000 | undef |
| Pancreas | 0.0066 | 0.0055 | 1.1966 | 0.8357 |
| Penis | 0.0120 | 0.0000 | undef | 0.0000 |
| Prostate | 0.0000 | 0.0000 | undef | undef |
| Uterus-endometrium | 0.0000 | 0.1055 | 0.0000 | undef |
| Uterus-myometrium | 0.0076 | 0.0068 | 1.1223 | 0.8911 |
| Uterus-general | 0.0051 | 0.0000 | undef | 0.0000 |
| Breast hyperplasia | 0.0096 |  |  |  |
| Prostate hyperplasia | 0.0030 |  |  |  |
| Seminal vesicle | 0.0000 |  |  |  |
| Sensory organs | 0.0000 |  |  |  |
| White blood cells | 0.0017 |  |  |  |
| Cervix | 0.0106 |  |  |  |

|  | FETUS % frequency | STANDARDIZED/SUBTRACTED LIBRARIES % frequency |
|---|---|---|
| Development | 0.0000 | Breast 0.0000 |
| Gastrointestinal | 0.0028 | Ovary_n 0.0000 |
| Brain | 0.0063 | Ovary_t 0.0000 |
| Hematopoietic | 0.0000 | Endocrine tissue 0.0000 |
| Skin | 0.0000 | Fetal 0.0029 |
| Hepatic | 0.0000 | Gastrointestinal 0.0000 |
| Heart-blood vessels | 0.0000 | Hematopoietic 0.0000 |
| Lung | 0.0072 | Skin-muscle 0.0000 |
| Suprarenal gland | 0.0000 | Testicles 0.0154 |
| Kidney | 0.0000 | Lung 0.0000 |
| Placenta | 0.0000 | Nerves 0.0030 |
| Prostate | 0.0000 | Prostate 0.0000 |
| Sensory organs | 0.0000 | Sensory Organs 0.0000 |
|  |  | Uterus_n 0.0083 |

Electronic Northern for SEQ. ID NO.: 24

|  | NORMAL % frequency | TUMOR % frequency | Ratios N/T | Ratios T/N |
|---|---|---|---|---|
| Bladder | 0.0000 | 0.0077 | 0.0000 | undef |
| Breast | 0.0064 | 0.0019 | 3.4026 | 0.2939 |
| Small intestine | 0.0031 | 0.0000 | undef | 0.0000 |
| Ovary | 0.0030 | 0.0000 | undef | 0.0000 |
| Endocrine tissue | 0.0068 | 0.0025 | 2.7170 | 0.3681 |
| Gastrointestinal | 0.0019 | 0.0000 | undef | 0.0000 |
| Brain | 0.0118 | 0.0031 | 3.8398 | 0.2604 |
| Hematopoietic | 0.0053 | 0.0000 | undef | 0.0000 |
| Skin | 0.0000 | 0.0000 | undef | undef |
| Hepatic | 0.0000 | 0.0000 | undef | undef |
| Heart | 0.0042 | 0.0000 | undef | 0.0000 |
| Testicles | 0.0000 | 0.0000 | undef | undef |
| Lung | 0.0010 | 0.0020 | 0.5080 | 1.9684 |
| Stomach-esophagus | 0.0000 | 0.0077 | 0.0000 | undef |
| Muscle-skeleton | 0.0000 | 0.0000 | undef | undef |
| Kidney | 0.0109 | 0.0000 | undef | 0.0000 |
| Pancreas | 0.0017 | 0.0000 | undef | 0.0000 |
| Penis | 0.0030 | 0.0000 | undef | 0.0000 |
| Prostate | 0.0044 | 0.0085 | 0.5118 | 1.9538 |

| | | | | |
|---|---|---|---|---|
| Uterus-endometrium | 0.0000 | 0.1583 | 0.0000 | undef |
| Uterus-myometrium | 0.0000 | 0.0000 | undef | undef |
| Uterus-general | 0.0051 | 0.0000 | undef | 0.0000 |
| Breast hyperplasia | 0.0032 | | | |
| Prostate hyperplasia | 0.0000 | | | |
| Seminal vesicle | 0.0000 | | | |
| Sensory organs | 0.0000 | | | |
| White blood cells | 0.0009 | | | |
| Cervix | 0.0000 | | | |

| | FETUS % frequency | STANDARDIZED/SUB-TRACTED LIBRARIES % frequency | |
|---|---|---|---|
| Development | 0.0139 | Breast | 0.0136 |
| Gastrointestinal | 0.0000 | Ovary_n | 0.0000 |
| Brain | 0.0063 | Ovary_t | 0.0000 |
| Hematopoietic | 0.0039 | Endocrine tissue | 0.0000 |
| Skin | 0.0000 | Fetal | 0.0111 |
| Hepatic | 0.0000 | Gastrointestinal | 0.0000 |
| Heart-blood vessels | 0.0036 | Hematopoietic | 0.0000 |
| Lung | 0.0000 | Skin-muscle | 0.0194 |
| Suprarenal gland | 0.0000 | Testicles | 0.0000 |
| Kidney | 0.0000 | Lung | 0.0082 |
| Placenta | 0.0000 | Nerves | 0.0080 |
| Prostate | 0.0000 | Prostate | 0.0000 |
| Sensory organs | 0.0377 | Sensory Organs | 0.0000 |
| | | Uterus_n | 0.0000 |

Electronic Northern for SEQ. ID NO.: 25

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0064 | 0.0000 | undef | 0.0000 |
| Small intestine | 0.0000 | 0.0000 | undef | undef |
| Ovary | 0.0030 | 0.0026 | 1.1513 | 0.8686 |
| Endocrine tissue | 0.0000 | 0.0000 | undef | undef |
| Gastrointestinal | 0.0019 | 0.0000 | undef | 0.0000 |
| Brain | 0.0000 | 0.0000 | undef | undef |
| Hematopoietic | 0.0000 | 0.0000 | undef | undef |
| Skin | 0.0110 | 0.0000 | undef | 0.0000 |
| Hepatic | 0.0048 | 0.0000 | undef | 0.0000 |
| Heart | 0.0042 | 0.0000 | undef | 0.0000 |
| Testicles | 0.0000 | 0.0000 | undef | undef |
| Lung | 0.0000 | 0.0041 | 0.0000 | undef |
| Stomach-esophagus | 0.0097 | 0.0000 | undef | 0.0000 |
| Muscle-skeleton | 0.0051 | 0.0000 | undef | 0.0000 |
| Kidney | 0.0027 | 0.0000 | undef | 0.0000 |
| Pancreas | 0.0017 | 0.0000 | undef | 0.0000 |
| Penis | 0.0030 | 0.0000 | undef | 0.0000 |
| Prostate | 0.0022 | 0.0000 | undef | 0.0000 |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0064 | | | |
| Prostate hyperplasia | 0.0000 | | | |
| Seminal vesicle | 0.0089 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0052 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 26

| | NORMAL | TUMOR | Ratios | |
|---|---|---|---|---|
| | % frequency | % frequency | N/T | T/N |
| Bladder | 0.0117 | 0.0102 | 1.1441 | 0.8741 |
| Breast | 0.0038 | 0.0038 | 1.0208 | 0.9796 |
| Small intestine | 0.0061 | 0.0000 | undef | 0.0000 |
| Ovary | 0.0000 | 0.0026 | 0.0000 | undef |
| Endocrine tissue | 0.0051 | 0.0025 | 2.0377 | 0.4907 |
| Gastrointestinal | 0.0038 | 0.0185 | 0.2071 | 4.8289 |
| Brain | 0.0037 | 0.0031 | 1.1999 | 0.8334 |
| Hematopoietic | 0.0027 | 0.0000 | undef | 0.0000 |
| Skin | 0.0000 | 0.0000 | undef | undef |
| Hepatic | 0.0095 | 0.0065 | 1.4706 | 0.6800 |
| Heart | 0.0011 | 0.0000 | undef | 0.0000 |
| Testicles | 0.0000 | 0.0000 | undef | undef |
| Lung | 0.0062 | 0.0041 | 1.5241 | 0.6561 |
| Stomach-esophagus | 0.0000 | 0.0000 | undef | undef |
| Muscle-skeleton | 0.0017 | 0.0000 | undef | 0.0000 |
| Kidney | 0.0136 | 0.0068 | 1.9826 | 0.5044 |
| Pancreas | 0.0000 | 0.0110 | 0.0000 | undef |
| Penis | 0.0030 | 0.0000 | undef | 0.0000 |
| Prostate | 0.0044 | 0.0021 | 2.0473 | 0.4885 |
| Uterus-endometrium | 0.0068 | 0.1055 | 0.0640 | 15.6211 |
| Uterus-myometrium | 0.0000 | 0.0000 | undef | undef |
| Uterus-general | 0.0102 | 0.0954 | 0.1067 | 9.3678 |
| Breast hyperplasia | 0.0000 | | | |
| Prostate hyperplasia | 0.0030 | | | |
| Seminal vesicle | 0.0000 | | | |
| Sensory organs | 0.0118 | | | |
| White blood cells | 0.0026 | | | |
| Cervix | 0.0000 | | | |

| | FETUS % frequency | STANDARDIZED/SUB-TRACTED LIBRARIES % frequency | |
|---|---|---|---|
| Development | 0.0139 | Breast | 0.0000 |
| Gastrointestinal | 0.0056 | Ovary_n | 0.0000 |
| Brain | 0.0000 | Ovary_t | 0.0101 |
| Hematopoietic | 0.0000 | Endocrine tissue | 0.0000 |
| Skin | 0.0000 | Fetal | 0.0140 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0680 |
| Suprarenal gland | 0.0000 | Testicles | 0.0000 |
| Kidney | 0.0000 | Lung | 0.0000 |
| Placenta | 0.0000 | Nerves | 0.0070 |
| Prostate | 0.0000 | Prostate | 0.0068 |
| Sensory organs | 0.0000 | Sensory Organs | 0.0000 |
| | | Uterus_n | 0.0042 |

Electronic Northern for SEQ. ID NO.: 27

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0019 | 0.0000 | undef |
| Small intestine | 0.0000 | 0.0000 | undef | undef |
| Ovary | 0.0030 | 0.0026 | 1.1513 | 0.8686 |
| Endocrine tissue | 0.0000 | 0.0125 | 0.0000 | undef |
| Gastrointestinal | 0.0019 | 0.0000 | undef | 0.0000 |
| Brain | 0.0059 | 0.0041 | 1.4399 | 0.6945 |
| Hematopoietic | 0.0000 | 0.0000 | undef | undef |
| Skin | 0.0037 | 0.0000 | undef | 0.0000 |
| Hepatic | 0.0000 | 0.0063 | 0.0000 | undef |
| Heart | 0.0011 | 0.0000 | undef | 0.0000 |
| Testicles | 0.0058 | 0.0000 | undef | 0.0000 |
| Lung | 0.0010 | 0.0020 | 0.5080 | 1.9684 |
| Stomach-esophagus | 0.0000 | 0.0000 | undef | undef |
| Muscle-skeleton | 0.0000 | 0.0000 | undef | undef |

| | -continued | | | |
|---|---|---|---|---|
| Kidney | 0.0000 | 0.0000 | undef | undef |
| Pancreas | 0.0000 | 0.0000 | undef | undef |
| Penis | 0.0030 | 0.0000 | undef | 0.0000 |
| Prostate | 0.0044 | 0.0000 | undef | 0.0000 |
| Uterus-endometrium | 0.0068 | 0.1055 | 0.0640 | 15.6211 |
| Uterus-myometrium | 0.0076 | 0.0068 | 1.1223 | 0.8911 |
| Uterus-general | 0.0000 | 0.0000 | undef | undef |
| Breast hyperplasia | 0.0032 | | | |
| Prostate hyperplasia | 0.0000 | | | |
| Seminal vesicle | 0.0000 | | | |
| Sensory organs | 0.0118 | | | |
| White blood cells | 0.0009 | | | |
| Cervix | 0.0000 | | | |

| | FETUS<br>% frequency | STANDARDIZED/SUB-<br>TRACTED LIBRARIES<br>% frequency |
|---|---|---|
| Development | 0.0139 | Breast 0.0204 |
| Gastrointestinal | 0.0000 | Ovary_n 0.0000 |
| Brain | 0.0000 | Ovary_t 0.0051 |
| Hematopoietic | 0.0000 | Endocrine tissue 0.0000 |
| Skin | 0.0000 | Fetal 0.0064 |
| Hepatic | 0.0000 | Gastrointestinal 0.0000 |
| Heart-blood vessels | 0.0036 | Hematopoietic 0.0000 |
| Lung | 0.0000 | Skin-muscle 0.0032 |
| Suprarenal gland | 0.0000 | Testicles 0.0000 |
| Kidney | 0.0000 | Lung 0.0000 |
| Placenta | 0.0000 | Nerves 0.0020 |
| Prostate | 0.0000 | Prostate 0.0000 |
| Sensory organs | 0.0000 | Sensory Organs 0.0232 |
| | | Uterus_n 0.0083 |

Electronic Northern for SEQ. ID NO.: 28

| | NORMAL | TUMOR | Ratios | |
|---|---|---|---|---|
| | % frequency | % frequency | N/T | T/N |
| Bladder | 0.0000 | 0.0051 | 0.0000 | undef |
| Breast | 0.0153 | 0.0094 | 1.6333 | 0.6123 |
| Small intestine | 0.0000 | 0.0000 | undef | undef |
| Ovary | 0.0030 | 0.0130 | 0.2303 | 4.3431 |
| Endocrine tissue | 0.0034 | 0.0025 | 1.3585 | 0.7361 |
| Gastrointestinal | 0.0019 | 0.0000 | undef | 0.0000 |
| Brain | 0.0030 | 0.0000 | undef | 0.0000 |
| Hematopoietic | 0.0000 | 0.0000 | undef | undef |
| Skin | 0.0184 | 0.0000 | undef | 0.0000 |
| Hepatic | 0.0048 | 0.0000 | undef | 0.0000 |
| Heart | 0.0074 | 0.0000 | undef | 0.0000 |
| Testicles | 0.0000 | 0.0000 | undef | undef |
| Lung | 0.0000 | 0.0020 | 0.0000 | undef |
| Stomach-esophagus | 0.0000 | 0.0000 | undef | undef |
| Muscle-skeleton | 0.0086 | 0.0060 | 1.4278 | 0.7004 |
| Kidney | 0.0027 | 0.0000 | undef | 0.0000 |
| Pancreas | 0.0033 | 0.0000 | undef | 0.0000 |
| Penis | 0.0030 | 0.0000 | undef | 0.0000 |
| Prostate | 0.0000 | 0.0000 | undef | undef |
| Uterus-endometrium | 0.0068 | 0.1055 | 0.0640 | 15.6211 |
| Uterus-myometrium | 0.0000 | 0.0000 | undef | undef |
| Uterus-general | 0.0000 | 0.0000 | undef | undef |
| Breast hyperplasia | 0.0256 | | | |
| Prostate hyperplasia | 0.0000 | | | |
| Seminal vesicle | 0.0000 | | | |
| Sensory organs | 0.0000 | | | |
| White blood cells | 0.0009 | | | |
| Cervix | 0.0000 | | | |

| | FETUS<br>% frequency | STANDARDIZED/SUB-<br>TRACTED LIBRARIES<br>% frequency |
|---|---|---|
| Development | 0.0000 | Breast 0.0204 |
| Gastrointestinal | 0.0028 | Ovary_n 0.0000 |
| Brain | 0.0000 | Ovary_t 0.0000 |
| Hematopoietic | 0.0000 | Endocrine tissue 0.0000 |
| Skin | 0.0000 | Fetal 0.0105 |
| Hepatic | 0.0520 | Gastrointestinal 0.0000 |
| Heart-blood vessels | 0.0000 | Hematopoietic 0.0171 |
| Lung | 0.0000 | Skin-muscle 0.0162 |
| Suprarenal gland | 0.0000 | Testicles 0.0000 |
| Kidney | 0.0062 | Lung 0.0000 |
| Placenta | 0.0000 | Nerves 0.0060 |
| Prostate | 0.0000 | Prostate 0.0000 |
| Sensory organs | 0.0000 | Sensory Organs 0.0000 |
| | | Uterus_n 0.0167 |

Electronic Northern for SEQ. ID NO.: 29

| | NORMAL | TUMOR | Ratios | |
|---|---|---|---|---|
| | % frequency | % frequency | N/T | T/N |
| Bladder | 0.0000 | 0.0128 | 0.0000 | undef |
| Breast | 0.0013 | 0.0038 | 0.3403 | 2.9389 |
| Small intestine | 0.0031 | 0.0000 | undef | 0.0000 |
| Ovary | 0.0000 | 0.0078 | 0.0000 | undef |
| Endocrine tissue | 0.0034 | 0.0025 | 1.3585 | 0.7361 |
| Gastrointestinal | 0.0038 | 0.0046 | 0.8283 | 1.2072 |
| Brain | 0.0000 | 0.0000 | undef | undef |
| Hematopoietic | 0.0000 | 0.0000 | undef | undef |
| Skin | 0.0037 | 0.0000 | undef | 0.0000 |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0061 | 0.0000 | undef |
| Stomach-esophagus | 0.0000 | 0.0000 | undef | undef |
| Muscle-skeleton | 0.0000 | 0.0000 | undef | undef |
| Kidney | 0.0027 | 0.0000 | undef | 0.0000 |
| Pancreas | 0.0017 | 0.0000 | undef | 0.0000 |
| Penis | 0.0000 | 0.0000 | undef | undef |
| Prostate | 0.0022 | 0.0085 | 0.2559 | 3.9077 |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0096 | | | |
| Prostate hyperplasia | 0.0119 | | | |
| Seminal vesicle | 0.0089 | | | |
| Sensory organs | 0.0000 | | | |
| White blood cells | 0.0000 | | | |
| Cervix | 0.0000 | | | |

| | FETUS<br>% frequency | STANDARDIZED/SUB-<br>TRACTED LIBRARIES<br>% frequency |
|---|---|---|
| Development | 0.0000 | Breast 0.0000 |
| Gastrointestinal | 0.0028 | Ovary_n 0.0000 |
| Brain | 0.0000 | Ovary_t 0.0051 |
| Hematopoietic | 0.0000 | Endocrine tissue 0.0000 |
| Skin | 0.0000 | Fetal 0.0012 |
| Hepatic | 0.0000 | Gastrointestinal 0.0000 |
| Heart-blood vessels | 0.0000 | Hematopoietic 0.0000 |
| Lung | 0.0000 | Skin-muscle 0.0000 |
| Suprarenal gland | 0.0000 | Testicles 0.0000 |
| Kidney | 0.0000 | Lung 0.0082 |
| Placenta | 0.0000 | Nerves 0.0000 |
| Prostate | 0.0000 | Prostate 0.0137 |
| Sensory organs | 0.0000 | Sensory Organs 0.0000 |
| | | Uterus_n 0.0000 |

Electronic Northern for SEQ. ID NO.: 30

| | NORMAL | TUMOR | Ratios | |
|---|---|---|---|---|
| | % frequency | % frequency | N/T | T/N |
| Bladder | 0.0000 | 0.0026 | 0.0000 | undef |
| Breast | 0.0026 | 0.0019 | 1.3611 | 0.7347 |
| Small intestine | 0.0000 | 0.0000 | undef | undef |
| Ovary | 0.0000 | 0.0104 | 0.0000 | undef |
| Endocrine tissue | 0.0034 | 0.0025 | 1.3585 | 0.7361 |
| Gastrointestinal | 0.0038 | 0.0000 | undef | 0.0000 |
| Brain | 0.0022 | 0.0010 | 2.1599 | 0.4630 |
| Hematopoietic | 0.0000 | 0.0000 | undef | undef |
| Skin | 0.0000 | 0.0000 | undef | undef |
| Hepatic | 0.0048 | 0.0000 | undef | 0.0000 |
| Heart | 0.0032 | 0.0000 | undef | 0.0000 |

-continued

| | | | |
|---|---|---|---|
| Testicles | 0.0000 | 0.0000 | undef | undef |
| Lung | 0.0021 | 0.0020 | 1.0161 | 0.9842 |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0044 | 0.0064 | 0.6824 | 1.4654 |
| Uterus-endometrium | 0.0135 | 0.1055 | 0.1280 | 7.8106 |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0030 | | | |
| Seminal vesicle | 0.0089 | | | |
| Sensory organs | 0.0000 | | | |
| White blood cells | 0.0009 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0082 |
| Placenta | 0.0000 | Nerves | 0.0020 |
| Prostate | 0.0000 | Prostate | 0.0000 |
| Sensory organs | 0.0000 | Sensory Organs | 0.0000 |
| | | Uterus_n | 0.0167 |

Electronic Northern for SEQ. ID NO.: 31

| | NORMAL % frequency | TUMOR % frequency | Ratios N/T | T/N |
|---|---|---|---|---|
| Bladder | 0.0039 | 0.0026 | 1.5254 | 0.6555 |
| Breast | 0.0013 | 0.0056 | 0.2268 | 4.4083 |
| Small intestine | 0.0061 | 0.0000 | undef | 0.0000 |
| Ovary | 0.0000 | 0.0078 | 0.0000 | undef |
| Endocrine tissue | 0.0017 | 0.0050 | 0.3396 | 2.9444 |
| Gastrointestinal | 0.0038 | 0.0046 | 0.8283 | 1.2072 |
| Brain | 0.0037 | 0.0041 | 0.8999 | 1.1112 |
| Hematopoietic | 0.0067 | 0.0000 | undef | 0.0000 |
| Skin | 0.0000 | 0.0000 | undef | undef |
| Hepatic | 0.0000 | 0.0065 | 0.0000 | undef |
| Heart | 0.0074 | 0.0000 | undef | 0.0000 |
| Testicles | 0.0000 | 0.0117 | 0.0000 | undef |
| Lung | 0.0042 | 0.0041 | 1.0161 | 0.9842 |
| Stomach-esophagus | 0.0000 | 0.0077 | 0.0000 | undef |
| Muscle-skeleton | 0.0034 | 0.0060 | 0.5711 | 1.7510 |
| Kidney | 0.0027 | 0.0137 | 0.1983 | 5.0439 |
| Pancreas | 0.0017 | 0.0000 | undef | 0.0000 |
| Penis | 0.0000 | 0.0267 | 0.0000 | undef |
| Prostate | 0.0022 | 0.0000 | undef | 0.0000 |
| Uterus-endometrium | 0.0000 | 0.1055 | 0.0000 | undef |
| Uterus-myometrium | 0.0076 | 0.0000 | undef | 0.0000 |
| Uterus-general | 0.0000 | 0.0000 | undef | undef |
| Breast hyperplasia | 0.0224 | | | |
| Prostate hyperplasia | 0.0030 | | | |
| Seminal vesicle | 0.0000 | | | |
| Sensory organs | 0.0000 | | | |
| White blood cells | 0.0035 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0028 | Ovary_n | 0.0000 |
| Brain | 0.0000 | Ovary_t | 0.0051 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0036 | Hematopoietic | 0.0000 |
| Lung | 0.0036 | Skin-muscle | 0.0000 |
| Suprarenal gland | 0.0000 | Testicles | 0.0077 |
| Kidney | 0.0000 | Lung | 0.0082 |
| Placenta | 0.0182 | Nerves | 0.0010 |
| Prostate | 0.0000 | Prostate | 0.0068 |
| Sensory organs | 0.0000 | Sensory Organs | 0.0000 |
| | | Uterus_n | 0.0042 |

Electronic Northern for SEQ. ID NO.: 32

| | NORMAL % frequency | TUMOR % frequency | Ratios N/T | T/N |
|---|---|---|---|---|
| Bladder | 0.0000 | 0.0000 | undef | undef |
| Breast | 0.0000 | 0.0038 | 0.0000 | undef |
| Small intestine | 0.0031 | 0.0000 | undef | 0.0000 |
| Ovary | 0.0000 | 0.0000 | undef | undef |
| Endocrine tissue | 0.0068 | 0.0050 | 1.3585 | 0.7361 |
| Gastrointestinal | 0.0038 | 0.0000 | undef | 0.0000 |
| Brain | 0.0022 | 0.0041 | 0.5400 | 1.8520 |
| Hematopoietic | 0.0027 | 0.0000 | undef | 0.0000 |
| Skin | 0.0000 | 0.0000 | undef | undef |
| Hepatic | 0.0048 | 0.0129 | 0.3676 | 2.7200 |
| Heart | 0.0032 | 0.0000 | undef | 0.0000 |
| Testicles | 0.0000 | 0.0000 | undef | undef |
| Lung | 0.0000 | 0.0020 | 0.0000 | undef |
| Stomach-esophagus | 0.0000 | 0.0000 | undef | undef |
| Muscle-skeleton | 0.0000 | 0.0000 | undef | undef |
| Kidney | 0.0054 | 0.0000 | undef | 0.0000 |
| Pancreas | 0.0000 | 0.0110 | 0.0000 | undef |
| Penis | 0.0000 | 0.0000 | undef | undef |
| Prostate | 0.0022 | 0.0043 | 0.5118 | 1.9538 |
| Uterus-endometrium | 0.0068 | 0.1055 | 0.0640 | 15.6211 |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0030 | | | |
| Seminal vesicle | 0.0000 | | | |
| Sensory organs | 0.0000 | | | |
| White blood cells | 0.0009 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0006 |
| Hepatic | 0.0000 | Gastrointestinal | 0.0000 |
| Heart-blood vessels | 0.0036 | Hematopoietic | 0.0000 |
| Lung | 0.0000 | Skin-muscle | 0.0000 |
| Suprarenal gland | 0.0000 | Testicles | 0.0000 |
| Kidney | 0.0062 | Lung | 0.0000 |
| Placenta | 0.0000 | Nerves | 0.0020 |
| Prostate | 0.0249 | Prostate | 0.0000 |
| Sensory organs | 0.0000 | Sensory Organs | 0.0000 |
| | | Uterus_n | 0.0000 |

Electronic Northern for SEQ. ID NO.: 33

| | NORMAL % frequency | TUMOR % frequency | Ratios N/T | T/N |
|---|---|---|---|---|
| Bladder | 0.0000 | 0.0000 | undef | undef |
| Breast | 0.0013 | 0.0000 | undef | 0.0000 |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |

-continued

| | | | |
|---|---|---|---|
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0017 | 0.0000 | undef | 0.0000 |
| Penis | 0.0000 | 0.0000 | undef | undef |
| Prostate | 0.0000 | 0.0000 | undef | undef |
| Uterus-endometrium | 0.0068 | 0.2639 | 0.0256 | 39.0528 |
| Uterus-myometrium | 0.0000 | 0.0000 | undef | undef |
| Uterus-general | 0.0051 | 0.0000 | undef | 0.0000 |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB- TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0154 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 34

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0025 | 0.0000 | undef |
| Gastrointestinal | 0.0000 | 0.0000 | undef | undef |
| Brain | 0.0000 | 0.0010 | 0.0000 | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0060 | 0.0000 | undef |
| Kidney | 0.0000 | 0.0068 | 0.0000 | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB- TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 35

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0026 | 0.0038 | 0.6805 | 1.4694 |
| Small intestine | 0.0000 | 0.0165 | 0.0000 | undef |
| Ovary | 0.0000 | 0.0026 | 0.0000 | undef |
| Endocrine tissue | 0.0034 | 0.0000 | undef | 0.0000 |
| Gastrointestinal | 0.0057 | 0.0000 | undef | 0.0000 |
| Brain | 0.0007 | 0.0021 | 0.3600 | 2.7779 |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0032 | 0.0000 | undef | 0.0000 |
| Testicles | 0.0000 | 0.0000 | undef | undef |
| Lung | 0.0010 | 0.0082 | 0.1270 | 7.8735 |
| Stomach-esophagus | 0.0000 | 0.0077 | 0.0000 | undef |
| Muscle-skeleton | 0.0034 | 0.0000 | undef | 0.0000 |
| Kidney | 0.0081 | 0.0479 | 0.1699 | 5.8845 |
| Pancreas | 0.0000 | 0.0000 | undef | undef |
| Penis | 0.0060 | 0.0000 | undef | 0.0000 |
| Prostate | 0.0044 | 0.0021 | 2.0473 | 0.4885 |
| Uterus-endometrium | 0.0068 | 0.2639 | 0.0256 | 39.0528 |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0059 | | | |
| Seminal vesicle | 0.0089 | | | |
| Sensory organs | 0.0000 | | | |
| White blood cells | 0.0052 | | | |
| Cervix | 0.0000 | | | |

| | FETUS % frequency | STANDARDIZED/SUB- TRACTED LIBRARIES % frequency | |
|---|---|---|---|
| Development | 0.0000 | Breast | 0.0340 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0029 |
| Hepatic | 0.0000 | Gastrointestinal | 0.0000 |
| Heart-blood vessels | 0.0000 | Hematopoietic | 0.0171 |
| Lung | 0.0036 | Skin-muscle | 0.0000 |
| Suprarenal gland | 0.0000 | Testicles | 0.0000 |
| Kidney | 0.0000 | Lung | 0.0246 |
| Placenta | 0.0000 | Nerves | 0.0030 |
| Prostate | 0.0000 | Prostate | 0.0000 |
| Sensory organs | 0.0000 | Sensory Organs | 0.0000 |
| | | Uterus_n | 0.0083 |

Electronic Northern for SEQ. ID NO.: 36

|  | NORMAL | TUMOR | Ratios | |
|---|---|---|---|---|
|  | % frequency | % frequency | N/T | T/N |
| Bladder | 0.0000 | 0.0026 | 0.0000 | undef |
| Breast | 0.0038 | 0.0019 | 2.0416 | 0.4898 |
| Small intestine | 0.0031 | 0.0000 | undef | 0.0000 |
| Ovary | 0.0000 | 0.0000 | undef | undef |
| Endocrine tissue | 0.0034 | 0.0000 | undef | 0.0000 |
| Gastrointestinal | 0.0057 | 0.0000 | undef | 0.0000 |
| Brain | 0.0015 | 0.0010 | 1.4399 | 0.6945 |
| Hematopoietic | 0.0040 | 0.0000 | undef | 0.0000 |
| Skin | 0.0037 | 0.0000 | undef | 0.0000 |
| Hepatic | 0.0000 | 0.0129 | 0.0000 | undef |
| Heart | 0.0000 | 0.0000 | undef | undef |
| Testicles | 0.0000 | 0.0000 | undef | undef |
| Lung | 0.0010 | 0.0000 | undef | 0.0000 |
| Stomach-esophagus | 0.0000 | 0.0000 | undef | undef |
| Muscle-skeleton | 0.0000 | 0.0120 | 0.0000 | undef |
| Kidney | 0.0000 | 0.0000 | undef | undef |
| Pancreas | 0.0000 | 0.0000 | undef | undef |
| Penis | 0.0030 | 0.0000 | undef | 0.0000 |
| Prostate | 0.0000 | 0.0021 | 0.0000 | undef |
| Uterus-endometrium | 0.0000 | 0.1055 | 0.0000 | undef |
| Uterus-myometrium | 0.0000 | 0.0068 | 0.0000 | undef |
| Uterus-general | 0.0000 | 0.0000 | undef | undef |
| Breast hyperplasia | 0.0032 |  |  |  |
| Prostate hyperplasia | 0.0000 |  |  |  |
| Seminal vesicle | 0.0000 |  |  |  |
| Sensory organs | 0.0000 |  |  |  |
| White blood cells | 0.0035 |  |  |  |
| Cervix | 0.0000 |  |  |  |

|  | FETUS % frequency | STANDARDIZED/SUB-TRACTED LIBRARIES % frequency |  |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0039 | Endocrine tissue | 0.0000 |
| Skin | 0.0000 | Fetal | 0.0000 |
| Hepatic | 0.0000 | Gastrointestinal | 0.0122 |
| Heart-blood vessels | 0.0000 | Hematopoietic | 0.0000 |
| Lung | 0.0000 | Skin-muscle | 0.0032 |
| Suprarenal gland | 0.0000 | Testicles | 0.0000 |
| Kidney | 0.0000 | Lung | 0.0000 |
| Placenta | 0.0000 | Nerves | 0.0030 |
| Prostate | 0.0000 | Prostate | 0.0000 |
| Sensory organs | 0.0000 | Sensory Organs | 0.0000 |
|  |  | Uterus_n | 0.0000 |

Electronic Northern for SEQ. ID NO.: 37

|  | NORMAL | TUMOR | Ratios | |
|---|---|---|---|---|
|  | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0010 | 0.0000 | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0044 | 0.0021 | 2.0473 | 0.4885 |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0032 |  |  |  |
| Prostate hyperplasia | 0.0000 |  |  |  |
| Seminal vesicle | 0.0000 |  |  |  |
| Sensory organs | 0.0118 |  |  |  |
| White blood cells | 0.0000 |  |  |  |
| Cervix | 0.0000 |  |  |  |

|  | FETUS % frequency | STANDARDIZED/SUB-TRACTED LIBRARIES % frequency |  |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0012 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
|  |  | Uterus_n | 0.0000 |

Electronic Northern for SEQ. ID NO.: 38

|  | NORMAL | TUMOR | Ratios | |
|---|---|---|---|---|
|  | % frequency | % frequency | N/T | T/N |
| Bladder | 0.0000 | 0.0000 | undef | undef |
| Breast | 0.0000 | 0.0019 | 0.0000 | undef |
| Small intestine | 0.0000 | 0.0000 | undef | undef |
| Ovary | 0.0030 | 0.0000 | undef | 0.0000 |
| Endocrine tissue | 0.0034 | 0.0000 | undef | 0.0000 |
| Gastrointestinal | 0.0019 | 0.0000 | undef | 0.0000 |
| Brain | 0.0007 | 0.0000 | undef | 0.0000 |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0011 | 0.0000 | undef | 0.0000 |
| Testicles | 0.0058 | 0.0000 | undef | 0.0000 |
| Lung | 0.0000 | 0.0000 | undef | undef |
| Stomach-esophagus | 0.0000 | 0.0000 | undef | undef |
| Muscle-skeleton | 0.0069 | 0.0120 | 0.5711 | 1.7510 |
| Kidney | 0.0000 | 0.0000 | undef | undef |
| Pancreas | 0.0000 | 0.0000 | undef | undef |
| Penis | 0.0030 | 0.0000 | undef | 0.0000 |
| Prostate | 0.0000 | 0.0000 | undef | undef |
| Uterus-endometrium | 0.0000 | 0.1055 | 0.0000 | undef |
| Uterus-myometrium | 0.0000 | 0.0068 | 0.0000 | undef |
| Uterus-general | 0.0000 | 0.0000 | undef | undef |
| Breast hyperplasia | 0.0032 |  |  |  |
| Prostate hyperplasia | 0.0000 |  |  |  |
| Seminal vesicle | 0.0000 |  |  |  |
| Sensory organs | 0.0000 |  |  |  |
| White blood cells | 0.0000 |  |  |  |
| Cervix | 0.0000 |  |  |  |

|  | FETUS % frequency | STANDARDIZED/SUB-TRACTED LIBRARIES % frequency |  |
|---|---|---|---|
| Development | 0.0139 | Breast | 0.0000 |
| Gastrointestinal | 0.0000 | Ovary_n | 0.0000 |
| Brain | 0.0063 | Ovary_t | 0.0000 |
| Hematopoietic | 0.0000 | Endocrine tissue | 0.0000 |
| Skin | 0.0000 | Fetal | 0.0023 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0032 |
| Suprarenal gland | 0.0000 | Testicles | 0.0077 |
| Kidney | 0.0000 | Lung | 0.0000 |
| Placenta | 0.0000 | Nerves | 0.0030 |

-continued

| | | | | |
|---|---|---|---|---|
| Prostate | 0.0000 | Prostate | | 0.0000 |
| Sensory organs | 0.0000 | Sensory Organs | | 0.0077 |
| | | Uterus_n | | 0.0000 |

Electronic Northern for SEQ. ID NO.: 39

| | NORMAL | TUMOR | Ratios | |
|---|---|---|---|---|
| | % frequency | % frequency | N/T | T/N |
| Bladder | 0.0000 | 0.0051 | 0.0000 | undef |
| Breast | 0.0013 | 0.0038 | 0.3403 | 2.9389 |
| Small intestine | 0.0000 | 0.0000 | undef | undef |
| Ovary | 0.0030 | 0.0052 | 0.5756 | 1.7372 |
| Endocrine tissue | 0.0000 | 0.0075 | 0.0000 | undef |
| Gastrointestinal | 0.0019 | 0.0046 | 0.4142 | 2.4145 |
| Brain | 0.0000 | 0.0010 | 0.0000 | undef |
| Hematopoietic | 0.0000 | 0.0000 | undef | undef |
| Skin | 0.0404 | 0.0000 | undef | 0.0000 |
| Hepatic | 0.0000 | 0.0065 | 0.0000 | undef |
| Heart | 0.0000 | 0.0000 | undef | undef |
| Testicles | 0.0000 | 0.0000 | undef | undef |
| Lung | 0.0073 | 0.0020 | 3.5562 | 0.2812 |
| Stomach-esophagus | 0.0000 | 0.0000 | undef | undef |
| Muscle-skeleton | 0.0000 | 0.0000 | undef | undef |
| Kidney | 0.0000 | 0.0068 | 0.0000 | undef |
| Pancreas | 0.0050 | 0.0055 | 0.8974 | 1.1143 |
| Penis | 0.0269 | 0.1066 | 0.2527 | 3.9571 |
| Prostate | 0.0022 | 0.0021 | 1.0236 | 0.9769 |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0064 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0106 | | | |

| | FETUS<br>% frequency | STANDARDIZED/SUB-<br>TRACTED LIBRARIES<br>% frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0101 |
| Hematopoietic | 0.0000 | Endocrine tissue | 0.0000 |
| Skin | 0.0000 | Fetal | 0.0064 |
| Hepatic | 0.0000 | Gastrointestinal | 0.0000 |
| Heart-blood vessels | 0.0036 | Hematopoietic | 0.0000 |
| Lung | 0.0108 | Skin-muscle | 0.0000 |
| Suprarenal gland | 0.0000 | Testicles | 0.0000 |
| Kidney | 0.0062 | Lung | 0.0082 |
| Placenta | 0.0000 | Nerves | 0.0000 |
| Prostate | 0.0000 | Prostate | 0.0068 |
| Sensory organs | 0.0000 | Sensory Organs | 0.0000 |
| | | Uterus_n | 0.0042 |

Electronic Northern for SEQ. ID NO.: 40

| | NORMAL | TUMOR | Ratios | |
|---|---|---|---|---|
| | % frequency | % frequency | N/T | T/N |
| Bladder | 0.0000 | 0.0026 | 0.0000 | undef |
| Breast | 0.0000 | 0.0019 | 0.0000 | undef |
| Small intestine | 0.0184 | 0.0000 | undef | 0.0000 |
| Ovary | 0.0030 | 0.0156 | 0.1919 | 5.2117 |
| Endocrine tissue | 0.0000 | 0.0000 | undef | undef |
| Gastrointestinal | 0.0096 | 0.0231 | 0.4142 | 2.4145 |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0065 | 0.0000 | undef |
| Heart | 0.0000 | 0.0000 | undef | undef |
| Testicles | 0.0000 | 0.0000 | undef | undef |
| Lung | 0.0010 | 0.0000 | undef | 0.0000 |
| Stomach-esophagus | 0.0000 | 0.0077 | 0.0000 | undef |
| Muscle-skeleton | 0.0000 | 0.0000 | undef | undef |
| Kidney | 0.0027 | 0.0068 | 0.3965 | 2.5219 |
| Pancreas | 0.0083 | 0.0000 | undef | 0.0000 |
| Penis | 0.0000 | 0.0000 | undef | undef |
| Prostate | 0.0022 | 0.0106 | 0.2047 | 4.8846 |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0064 | | | |
| Prostate hyperplasia | 0.0089 | | | |
| Seminal vesicle | 0.0000 | | | |
| Sensory organs | 0.0000 | | | |
| White blood cells | 0.0000 | | | |
| Cervix | 0.0000 | | | |

| | FETUS<br>% frequency | STANDARDIZED/SUB-<br>TRACTED LIBRARIES<br>% frequency | |
|---|---|---|---|
| Development | 0.0139 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0047 |
| Hepatic | 0.0000 | Gastrointestinal | 0.0000 |
| Heart-blood vessels | 0.0000 | Hematopoietic | 0.0000 |
| Lung | 0.0072 | Skin-muscle | 0.0000 |
| Suprarenal gland | 0.0000 | Testicles | 0.0000 |
| Kidney | 0.0000 | Lung | 0.0082 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 41

| | NORMAL | TUMOR | Ratios | |
|---|---|---|---|---|
| | % frequency | % frequency | N/T | T/N |
| Bladder | 0.0000 | 0.0026 | 0.0000 | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0011 | 0.0000 | undef | 0.0000 |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0032 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS<br>% frequency | STANDARDIZED/SUB-<br>TRACTED LIBRARIES<br>% frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0057 |

-continued

| | | | | |
|---|---|---|---|---|
| Lung | 0.0000 | Skin-muscle | | 0.0000 |
| Suprarenal gland | 0.0000 | Testicles | | 0.0000 |
| Kidney | 0.0000 | Lung | | 0.0000 |
| Placenta | 0.0000 | Nerves | | 0.0000 |
| Prostate | 0.0000 | Prostate | | 0.0000 |
| Sensory organs | 0.0000 | Sensory Organs | | 0.0000 |
| | | Uterus_n | | 0.0000 |

Electronic Northern for SEQ. ID NO.: 42

| | NORMAL | TUMOR | Ratios | |
|---|---|---|---|---|
| | % frequency | % frequency | N/T | T/N |
| Bladder | 0.0156 | 0.0077 | 2.0339 | 0.4917 |
| Breast | 0.0051 | 0.0113 | 0.4537 | 2.2042 |
| Small intestine | 0.0092 | 0.0165 | 0.5561 | 1.7982 |
| Ovary | 0.0000 | 0.0208 | 0.0000 | undef |
| Endocrine tissue | 0.0136 | 0.0251 | 0.5434 | 1.8403 |
| Gastrointestinal | 0.0153 | 0.0185 | 0.8283 | 1.2072 |
| Brain | 0.0118 | 0.0041 | 2.8798 | 0.3472 |
| Hematopoietic | 0.0067 | 0.0000 | undef | 0.0000 |
| Skin | 0.0073 | 0.0000 | undef | 0.0000 |
| Hepatic | 0.0095 | 0.0129 | 0.7353 | 1.3600 |
| Heart | 0.0064 | 0.0275 | 0.2313 | 4.3235 |
| Testicles | 0.0000 | 0.0234 | 0.0000 | undef |
| Lung | 0.0187 | 0.0164 | 1.1431 | 0.8748 |
| Stomach-esophagus | 0.0000 | 0.0000 | undef | undef |
| Muscle-skeleton | 0.0069 | 0.0060 | 1.1422 | 0.8755 |
| Kidney | 0.0081 | 0.0205 | 0.3965 | 2.5219 |
| Pancreas | 0.0182 | 0.0055 | 3.2906 | 0.3039 |
| Penis | 0.0120 | 0.0267 | 0.4493 | 2.2259 |
| Prostate | 0.0131 | 0.0213 | 0.6142 | 1.6282 |
| Uterus-endometrium | 0.0135 | 0.1583 | 0.0854 | 11.7158 |
| Uterus-myometrium | 0.0000 | 0.0000 | undef | undef |
| Uterus-general | 0.0000 | 0.0000 | undef | undef |
| Breast hyperplasia | 0.0192 | | | |
| Prostate hyperplasia | 0.0089 | | | |
| Seminal vesicle | 0.0089 | | | |
| Sensory organs | 0.0000 | | | |
| White blood cells | 0.0199 | | | |
| Cervix | 0.0106 | | | |

| | FETUS % frequency | STANDARDIZED/SUB-TRACTED LIBRARIES % frequency | |
|---|---|---|---|
| Development | 0.0000 | Breast | 0.0204 |
| Gastrointestinal | 0.0028 | Ovary_n | 0.0000 |
| Brain | 0.0000 | Ovary_t | 0.0101 |
| Hematopoietic | 0.0039 | Endocrine tissue | 0.0490 |
| Skin | 0.0000 | Fetal | 0.0122 |
| Hepatic | 0.0000 | Gastrointestinal | 0.0000 |
| Heart-blood vessels | 0.0071 | Hematopoietic | 0.0399 |
| Lung | 0.0072 | Skin-muscle | 0.0454 |
| Suprarenal gland | 0.0000 | Testicles | 0.0231 |
| Kidney | 0.0000 | Lung | 0.0082 |
| Placenta | 0.0182 | Nerves | 0.0301 |
| Prostate | 0.0499 | Prostate | 0.0068 |
| Sensory organs | 0.0126 | Sensory Organs | 0.0000 |
| | | Uterus_n | 0.0167 |

Electronic Northern for SEQ. ID NO.: 43

| | NORMAL | TUMOR | Ratios | |
|---|---|---|---|---|
| | % frequency | % frequency | N/T | T/N |
| Bladder | 0.0117 | 0.0102 | 1.1441 | 0.8741 |
| Breast | 0.0102 | 0.0226 | 0.4537 | 2.2042 |
| Small intestine | 0.0123 | 0.0165 | 0.7415 | 1.3487 |
| Ovary | 0.0030 | 0.0078 | 0.3838 | 2.6058 |
| Endocrine tissue | 0.0136 | 0.0150 | 0.9057 | 1.1042 |
| Gastrointestinal | 0.0153 | 0.0046 | 3.3134 | 0.3018 |
| Brain | 0.0074 | 0.0103 | 0.7200 | 1.3890 |
| Hematopoietic | 0.0053 | 0.0379 | 0.1412 | 7.0845 |
| Skin | 0.0000 | 0.0000 | undef | undef |
| Hepatic | 0.0143 | 0.0129 | 1.1029 | 0.9067 |
| Heart | 0.0074 | 0.0137 | 0.5397 | 1.8529 |
| Testicles | 0.0173 | 0.0000 | undef | 0.0000 |
| Lung | 0.0125 | 0.0164 | 0.7621 | 1.3122 |
| Stomach-esophagus | 0.0097 | 0.0153 | 0.6303 | 1.5866 |
| Muscle-skeleton | 0.0154 | 0.0060 | 2.5700 | 0.3891 |
| Kidney | 0.0109 | 0.0137 | 0.7930 | 1.2610 |
| Pancreas | 0.0083 | 0.0276 | 0.2991 | 3.3428 |
| Penis | 0.0150 | 0.0533 | 0.2808 | 3.5614 |
| Prostate | 0.0196 | 0.0149 | 1.3161 | 0.7598 |
| Uterus-endometrium | 0.0000 | 0.1055 | 0.0000 | undef |
| Uterus-myometrium | 0.0000 | 0.0136 | 0.0000 | undef |
| Uterus-general | 0.0153 | 0.0000 | undef | 0.0000 |
| Breast hyperplasia | 0.0032 | | | |
| Prostate hyperplasia | 0.0208 | | | |
| Seminal vesicle | 0.0178 | | | |
| Sensory organs | 0.0706 | | | |
| White blood cells | 0.0251 | | | |
| Cervix | 0.0106 | | | |

| | FETUS % frequency | STANDARDIZED/SUB-TRACTED LIBRARIES % frequency | |
|---|---|---|---|
| Development | 0.0139 | Breast | 0.0272 |
| Gastrointestinal | 0.0139 | Ovary_n | 0.0000 |
| Brain | 0.0125 | Ovary_t | 0.0557 |
| Hematopoietic | 0.0118 | Endocrine tissue | 0.0245 |
| Skin | 0.0000 | Fetal | 0.0402 |
| Hepatic | 0.0000 | Gastrointestinal | 0.0610 |
| Heart-blood vessels | 0.0000 | Hematopoietic | 0.0342 |
| Lung | 0.0217 | Skin-muscle | 0.0486 |
| Suprarenal gland | 0.0254 | Testicles | 0.0309 |
| Kidney | 0.0185 | Lung | 0.0328 |
| Placenta | 0.0303 | Nerves | 0.0100 |
| Prostate | 0.0000 | Prostate | 0.0274 |
| Sensory organs | 0.0000 | Sensory Organs | 0.0310 |
| | | Uterus_n | 0.0291 |

Electronic Northern for SEQ. ID NO.: 44

| | NORMAL | TUMOR | Ratios | |
|---|---|---|---|---|
| | % frequency | % frequency | N/T | T/N |
| Bladder | 0.0000 | 0.0026 | 0.0000 | undef |
| Breast | 0.0026 | 0.0019 | 1.3611 | 0.7347 |
| Small intestine | 0.0000 | 0.0000 | undef | undef |
| Ovary | 0.0030 | 0.0000 | undef | 0.0000 |
| Endocrine tissue | 0.0017 | 0.0000 | undef | 0.0000 |
| Gastrointestinal | 0.0019 | 0.0000 | undef | 0.0000 |
| Brain | 0.0007 | 0.0000 | undef | 0.0000 |
| Hematopoietic | 0.0000 | 0.0000 | undef | undef |
| Skin | 0.0037 | 0.0000 | undef | 0.0000 |
| Hepatic | 0.0000 | 0.0000 | undef | undef |
| Heart | 0.0000 | 0.0000 | undef | undef |
| Testicles | 0.0000 | 0.0117 | 0.0000 | undef |
| Lung | 0.0000 | 0.0020 | 0.0000 | undef |
| Stomach-esophagus | 0.0000 | 0.0000 | undef | undef |
| Muscle-skeleton | 0.0000 | 0.0000 | undef | undef |
| Kidney | 0.0027 | 0.0000 | undef | 0.0000 |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1583 | 0.0000 | undef |
| Uterus-myometrium | 0.0000 | 0.0000 | undef | undef |
| Uterus-general | 0.0051 | 0.0000 | undef | 0.0000 |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0139 | Breast | 0.0000 |
| Gastrointestinal | 0.0000 | Ovary_n | 0.0000 |
| Brain | 0.0000 | Ovary_t | 0.0000 |

-continued

| | | | |
|---|---|---|---|
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0082 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 45

| | NORMAL | TUMOR | Ratios | |
|---|---|---|---|---|
| | % frequency | % frequency | N/T | T/N |
| Bladder | 0.0039 | 0.0051 | 0.7627 | 1.3111 |
| Breast | 0.0013 | 0.0094 | 0.1361 | 7.3472 |
| Small intestine | 0.0000 | 0.0000 | undef | undef |
| Ovary | 0.0030 | 0.0026 | 1.1513 | 0.8686 |
| Endocrine tissue | 0.0017 | 0.0100 | 0.1698 | 5.8889 |
| Gastrointestinal | 0.0134 | 0.0093 | 1.4496 | 0.6898 |
| Brain | 0.0052 | 0.0062 | 0.8400 | 1.1905 |
| Hematopoietic | 0.0000 | 0.0000 | undef | undef |
| Skin | 0.0073 | 0.0000 | undef | 0.0000 |
| Hepatic | 0.0000 | 0.0000 | undef | undef |
| Heart | 0.0053 | 0.0412 | 0.1285 | 7.7824 |
| Testicles | 0.0058 | 0.0117 | 0.4920 | 2.0326 |
| Lung | 0.0052 | 0.0000 | undef | 0.0000 |
| Stomach-esophagus | 0.0000 | 0.0000 | undef | undef |
| Muscle-skeleton | 0.0069 | 0.0060 | 1.1422 | 0.8755 |
| Kidney | 0.0027 | 0.0068 | 0.3965 | 2.5219 |
| Pancreas | 0.0017 | 0.0221 | 0.0748 | 13.3713 |
| Penis | 0.0090 | 0.0000 | undef | 0.0000 |
| Prostate | 0.0087 | 0.0085 | 1.0236 | 0.9769 |
| Uterus-endometrium | 0.0000 | 0.1583 | 0.0000 | undef |
| Uterus-myometrium | 0.0152 | 0.0204 | 0.7482 | 1.3366 |
| Uterus-general | 0.0051 | 0.0000 | undef | 0.0000 |
| Breast hyperplasia | 0.0032 | | | |
| Prostate hyperplasia | 0.0059 | | | |
| Seminal vesicle | 0.0000 | | | |
| Sensory organs | 0.0000 | | | |
| White blood cells | 0.0035 | | | |
| Cervix | 0.0000 | | | |

| | FETUS % frequency | STANDARDIZED/SUBTRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0063 | Ovary_t | 0.0051 |
| Hematopoietic | 0.0000 | Endocrine tissue | 0.0000 |
| Skin | 0.0000 | Fetal | 0.0012 |
| Hepatic | 0.0000 | Gastrointestinal | 0.0000 |
| Heart-blood vessels | 0.0036 | Hematopoietic | 0.0000 |
| Lung | 0.0072 | Skin-muscle | 0.0000 |
| Suprarenal gland | 0.0000 | Testicles | 0.0000 |
| Kidney | 0.0000 | Lung | 0.0000 |
| Placenta | 0.0182 | Nerves | 0.0040 |
| Prostate | 0.0000 | Prostate | 0.0000 |
| Sensory organs | 0.0000 | Sensory Organs | 0.0000 |
| | | Uterus_n | 0.0042 |

Electronic Northern for SEQ. ID NO.: 46

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0061 | 0.0000 | undef | 0.0000 |
| Ovary | 0.0000 | 0.0026 | 0.0000 | undef |
| Endocrine tissue | 0.0000 | 0.0025 | 0.0000 | undef |
| Gastrointestinal | 0.0000 | 0.0000 | undef | undef |
| Brain | 0.0022 | 0.0010 | 2.1599 | 0.4630 |
| Hematopoietic | 0.0000 | 0.0000 | undef | undef |
| Skin | 0.0000 | 0.0000 | undef | undef |
| Hepatic | 0.0048 | 0.0000 | undef | 0.0000 |
| Heart | 0.0042 | 0.0000 | undef | 0.0000 |
| Testicles | 0.0000 | 0.0000 | undef | undef |
| Lung | 0.0000 | 0.0000 | undef | undef |
| Stomach-esophagus | 0.0097 | 0.0000 | undef | 0.0000 |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0030 | 0.0000 | undef | 0.0000 |
| Prostate | 0.0000 | 0.0000 | undef | undef |
| Uterus-endometrium | 0.0000 | 0.1583 | 0.0000 | undef |
| Uterus-myometrium | 0.0000 | 0.0000 | undef | undef |
| Uterus-general | 0.0000 | 0.0000 | undef | undef |
| Breast hyperplasia | 0.0032 | | | |
| Prostate hyperplasia | 0.0030 | | | |
| Seminal vesicle | 0.0000 | | | |
| Sensory organs | 0.0000 | | | |
| White blood cells | 0.0009 | | | |
| Cervix | 0.0000 | | | |

| | FETUS % frequency | STANDARDIZED/SUBTRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0039 | Endocrine tissue | 0.0000 |
| Skin | 0.0000 | Fetal | 0.0012 |
| Hepatic | 0.0000 | Gastrointestinal | 0.0000 |
| Heart-blood vessels | 0.0107 | Hematopoietic | 0.0000 |
| Lung | 0.0036 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0249 | Prostate | 0.0000 |
| Sensory organs | 0.0000 | Sensory Organs | 0.0000 |
| | | Uterus_n | 0.0000 |

Electronic Northern for SEQ. ID NO.: 47

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0012 | 0.0000 | undef | 0.0000 |
| Small intestine | 0.0031 | 0.0000 | undef | 0.0000 |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0015 | 0.0010 | 1.4399 | 0.6945 |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0011 | 0.0000 | undef | 0.0000 |
| Testicles | 0.0000 | 0.0000 | undef | undef |
| Lung | 0.0010 | 0.0000 | undef | 0.0000 |
| Stomach-esophagus | 0.0000 | 0.0000 | undef | undef |
| Muscle-skeleton | 0.0017 | 0.0060 | 0.2856 | 3.5020 |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1583 | 0.0000 | undef |
| Uterus-myometrium | 0.0152 | 0.0000 | undef | 0.0000 |
| Uterus-general | 0.0000 | 0.0000 | undef | undef |
| Breast hyperplasia | 0.0000 | | | |
| Prostate hyperplasia | 0.0030 | | | |
| Seminal vesicle | 0.0000 | | | |
| Sensory organs | 0.0000 | | | |
| White blood cells | 0.0000 | | | |
| Cervix | 0.0000 | | | |

-continued

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0006 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 48

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0015 | 0.0010 | 1.4399 | 0.6945 |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0011 | 0.0000 | undef | 0.0000 |
| Testicles | 0.0000 | 0.0000 | undef | undef |
| Lung | 0.0010 | 0.0000 | undef | 0.0000 |
| Stomach-esophagus | 0.0000 | 0.0000 | undef | undef |
| Muscle-skeleton | 0.0017 | 0.0060 | 0.2856 | 3.5020 |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.2111 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0030 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0006 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 49

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0013 | 0.0000 | undef | 0.0000 |
| Small intestine | 0.0000 | 0.0165 | 0.0000 | undef |
| Ovary | 0.0000 | 0.0000 | undef | undef |
| Endocrine tissue | 0.0017 | 0.0050 | 0.3396 | 2.9444 |
| Gastrointestinal | 0.0000 | 0.0000 | undef | undef |
| Brain | 0.0000 | 0.0010 | 0.0000 | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0030 | 0.0000 | undef | 0.0000 |
| Prostate | 0.0000 | 0.0000 | undef | undef |
| Uterus-endometrium | 0.0068 | 0.1055 | 0.0640 | 15.6211 |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0204 |
| Gastrointestinal | 0.0028 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0012 |
| Hepatic | 0.0000 | Gastrointestinal | 0.0000 |
| Heart-blood vessels | 0.0000 | Hematopoietic | 0.0000 |
| Lung | 0.0036 | Skin-muscle | 0.0065 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 50

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |

-continued

| | | | | |
|---|---|---|---|---|
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB- TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 51

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1583 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB- TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 52

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0030 | 0.0000 | undef | 0.0000 |
| Endocrine tissue | 0.0000 | 0.0125 | 0.0000 | undef |
| Gastrointestinal | 0.0000 | 0.0000 | undef | undef |
| Brain | 0.0044 | 0.0000 | undef | 0.0000 |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0010 | 0.0000 | undef | 0.0000 |
| Stomach-esophagus | 0.0000 | 0.0000 | undef | undef |
| Muscle-skeleton | 0.0000 | 0.0000 | undef | undef |
| Kidney | 0.0027 | 0.0000 | undef | 0.0000 |
| Pancreas | 0.0000 | 0.0000 | undef | undef |
| Penis | 0.0000 | 0.0000 | undef | undef |
| Prostate | 0.0022 | 0.0021 | 1.0236 | 0.9769 |
| Uterus-endometrium | 0.0000 | 0.1583 | 0.0000 | undef |
| Uterus-myometrium | 0.0000 | 0.0068 | 0.0000 | undef |
| Uterus-general | 0.0000 | 0.0000 | undef | undef |
| Breast hyperplasia | 0.0000 | | | |
| Prostate hyperplasia | 0.0030 | | | |
| Seminal vesicle | 0.0000 | | | |
| Sensory organs | 0.0000 | | | |
| White blood cells | 0.0000 | | | |
| Cervix | 0.0106 | | | |

| | FETUS % frequency | STANDARDIZED/SUB- TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0006 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0040 |
| Prostate | 0.0000 | Prostate | 0.0068 |
| Sensory organs | 0.0000 | Sensory Organs | 0.0000 |
| | | Uterus_n | 0.0000 |

Electronic Northern for SEQ. ID NO.: 53

| | NORMAL | TUMOR | Ratios | |
|---|---|---|---|---|
| | % frequency | % frequency | N/T | T/N |
| Bladder | 0.0039 | 0.0051 | 0.7627 | 1.3111 |
| Breast | 0.0051 | 0.0000 | undef | 0.0000 |
| Small intestine | 0.0000 | 0.0000 | undef | undef |
| Ovary | 0.0000 | 0.0000 | undef | undef |
| Endocrine tissue | 0.0034 | 0.0025 | 1.3585 | 0.7361 |
| Gastrointestinal | 0.0019 | 0.0000 | undef | 0.0000 |
| Brain | 0.0015 | 0.0031 | 0.4800 | 2.0835 |
| Hematopoietic | 0.0067 | 0.0000 | undef | 0.0000 |
| Skin | 0.0441 | 0.0000 | undef | 0.0000 |
| Hepatic | 0.0048 | 0.0065 | 0.7353 | 1.3600 |
| Heart | 0.0064 | 0.0000 | undef | 0.0000 |
| Testicles | 0.0000 | 0.0000 | undef | undef |
| Lung | 0.0010 | 0.0020 | 0.5080 | 1.9684 |
| Stomach-esophagus | 0.0000 | 0.0000 | undef | undef |
| Muscle-skeleton | 0.0017 | 0.0060 | 0.2856 | 3.5020 |

-continued

| | | | |
|---|---|---|---|
| Kidney | 0.0027 | 0.0000 | undef | 0.0000 |
| Pancreas | 0.0000 | 0.0000 | undef | undef |
| Penis | 0.0000 | 0.0267 | 0.0000 | undef |
| Prostate | 0.0044 | 0.0000 | undef | 0.0000 |
| Uterus-endometrium | 0.0068 | 0.1055 | 0.0640 | 15.6211 |
| Uterus-myometrium | 0.0000 | 0.0000 | undef | undef |
| Uterus-general | 0.0000 | 0.0954 | 0.0000 | undef |
| Breast hyperplasia | 0.0032 | | | |
| Prostate hyperplasia | 0.0000 | | | |
| Seminal vesicle | 0.0000 | | | |
| Sensory organs | 0.0000 | | | |
| White blood cells | 0.0026 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0101 |
| Hematopoietic | 0.0000 | Endocrine tissue | 0.0000 |
| Skin | 0.0000 | Fetal | 0.0017 |
| Hepatic | 0.0000 | Gastrointestinal | 0.0244 |
| Heart-blood vessels | 0.0000 | Hematopoietic | 0.0000 |
| Lung | 0.0000 | Skin-muscle | 0.0065 |
| Suprarenal gland | 0.0254 | Testicles | 0.0077 |
| Kidney | 0.0000 | Lung | 0.0082 |
| Placenta | 0.0061 | Nerves | 0.0010 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 54

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0026 | 0.0019 | 1.3611 | 0.7347 |
| Small intestine | 0.0000 | 0.0000 | undef | undef |
| Ovary | 0.0000 | 0.0000 | undef | undef |
| Endocrine tissue | 0.0000 | 0.0025 | 0.0000 | undef |
| Gastrointestinal | 0.0019 | 0.0000 | undef | 0.0000 |
| Brain | 0.0000 | 0.0000 | undef | undef |
| Hematopoietic | 0.0013 | 0.0000 | undef | 0.0000 |
| Skin | 0.0000 | 0.0000 | undef | undef |
| Hepatic | 0.0000 | 0.0000 | undef | undef |
| Heart | 0.0021 | 0.0000 | undef | 0.0000 |
| Testicles | 0.0000 | 0.0000 | undef | undef |
| Lung | 0.0010 | 0.0020 | 0.5080 | 1.9684 |
| Stomach-esophagus | 0.0000 | 0.0000 | undef | undef |
| Muscle-skeleton | 0.0000 | 0.0000 | undef | undef |
| Kidney | 0.0027 | 0.0000 | undef | 0.0000 |
| Pancreas | 0.0000 | 0.0000 | undef | undef |
| Penis | 0.0000 | 0.0000 | undef | undef |
| Prostate | 0.0022 | 0.0106 | 0.2047 | 4.8846 |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0032 | | | |
| Prostate hyperplasia | 0.0059 | | | |
| Seminal vesicle | 0.0000 | | | |
| Sensory organs | 0.0000 | | | |
| White blood cells | 0.0009 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0028 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0122 |
| Heart-blood vessels | 0.0071 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0061 | Nerves | 0.0000 |
| Prostate | 0.0000 | Prostate | 0.0000 |
| Sensory organs | 0.0126 | Sensory Organs | 0.0000 |
| | | Uterus_n | 0.0000 |

Electronic Northern for SEQ. ID NO.: 55

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0013 | 0.0019 | 0.6805 | 1.4694 |
| Small intestine | 0.0031 | 0.0000 | undef | 0.0000 |
| Ovary | 0.0060 | 0.0026 | 2.3025 | 0.4343 |
| Endocrine tissue | 0.0017 | 0.0050 | 0.3396 | 2.9444 |
| Gastrointestinal | 0.0022 | 0.0093 | 0.6213 | 1.6096 |
| Brain | 0.0027 | 0.0041 | 0.5400 | 1.8520 |
| Hematopoietic | 0.0000 | 0.0000 | undef | 0.0000 |
| Skin | 0.0048 | 0.0000 | undef | undef |
| Hepatic | 0.0000 | 0.0000 | undef | 0.0000 |
| Heart | 0.0000 | 0.0000 | undef | undef |
| Testicles | 0.0010 | 0.0117 | 0.0000 | undef |
| Lung | 0.0000 | 0.0020 | 0.5080 | 1.9684 |
| Stomach-esophagus | 0.0000 | 0.0077 | 0.0000 | undef |
| Muscle-skeleton | 0.0054 | 0.0000 | undef | undef |
| Kidney | 0.0000 | 0.0068 | 0.7930 | 1.2610 |
| Pancreas | 0.0000 | 0.0000 | undef | undef |
| Penis | 0.0007 | 0.0000 | undef | undef |
| Prostate | 0.0068 | 0.0000 | undef | 0.0000 |
| Uterus-endometrium | 0.0000 | 0.1055 | 0.0640 | 15.6211 |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0030 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0028 | Ovary_n | 0.0000 |
| Brain | 0.0000 | Ovary_t | 0.0000 |
| Hematopoietic | 0.0039 | Endocrine tissue | 0.0000 |
| Skin | 0.0000 | Fetal | 0.0017 |
| Hepatic | 0.0000 | Gastrointestinal | 0.0000 |
| Heart-blood vessels | 0.0036 | Hematopoietic | 0.0000 |
| Lung | 0.0036 | Skin-muscle | 0.0032 |
| Suprarenal gland | 0.0000 | Testicles | 0.0000 |
| Kidney | 0.0062 | Lung | 0.0000 |
| Placenta | 0.0061 | Nerves | 0.0030 |
| Prostate | 0.0000 | Prostate | 0.0000 |
| Sensory organs | 0.0000 | Sensory Organs | 0.0000 |
| | | Uterus_n | 0.0042 |

Electronic Northern for SEQ. ID NO.: 56

| | NORMAL | TUMOR | Ratios | |
|---|---|---|---|---|
| | % frequency | % frequency | N/T | T/N |
| Bladder | 0.0117 | 0.0128 | 0.9153 | 1.0926 |
| Breast | 0.0051 | 0.0132 | 0.3889 | 2.5715 |
| Small intestine | 0.0061 | 0.0000 | undef | 0.0000 |
| Ovary | 0.0000 | 0.0208 | 0.0000 | undef |
| Endocrine tissue | 0.0102 | 0.0125 | 0.8151 | 1.2268 |
| Gastrointestinal | 0.0134 | 0.0046 | 2.8992 | 0.3449 |
| Brain | 0.0103 | 0.0113 | 0.9163 | 1.0913 |
| Hematopoietic | 0.0027 | 0.0000 | undef | 0.0000 |
| Skin | 0.0037 | 0.0000 | undef | 0.0000 |
| Hepatic | 0.0000 | 0.0194 | 0.0000 | undef |
| Heart | 0.0085 | 0.0000 | undef | 0.0000 |

-continued

| | | | |
|---|---|---|---|
| Testicles | 0.0173 | 0.0234 | 0.7380 | 1.3551 |
| Lung | 0.0145 | 0.0123 | 1.1854 | 0.8436 |
| Stomach-esophagus | 0.0097 | 0.0077 | 1.2605 | 0.7933 |
| Muscle-skeleton | 0.0069 | 0.0000 | undef | 0.0000 |
| Kidney | 0.0190 | 0.0000 | undef | 0.0000 |
| Pancreas | 0.0050 | 0.0055 | 0.8974 | 1.1143 |
| Penis | 0.0090 | 0.0000 | undef | 0.0000 |
| Prostate | 0.0022 | 0.0085 | 0.2559 | 3.9077 |
| Uterus-endometrium | 0.0068 | 0.1055 | 0.0640 | 15.6211 |
| Uterus-myometrium | 0.0076 | 0.0068 | 1.1223 | 0.8911 |
| Uterus-general | 0.0000 | 0.0000 | undef | undef |
| Breast hyperplasia | 0.0096 | | | |
| Prostate hyperplasia | 0.0030 | | | |
| Seminal vesicle | 0.0178 | | | |
| Sensory organs | 0.0000 | | | |
| White blood cells | 0.0052 | | | |
| Cervix | 0.0000 | | | |

| | FETUS % frequency | STANDARDIZED/SUB-TRACTED LIBRARIES % frequency | | |
|---|---|---|---|---|
| Development | 0.0000 | Breast | 0.0000 |
| Gastrointestinal | 0.0028 | Ovary_n | 0.0000 |
| Brain | 0.0063 | Ovary_t | 0.0051 |
| Hematopoietic | 0.0000 | Endocrine tissue | 0.0000 |
| Skin | 0.0000 | Fetal | 0.0012 |
| Hepatic | 0.0260 | Gastrointestinal | 0.0366 |
| Heart-blood vessels | 0.0107 | Hematopoietic | 0.0000 |
| Lung | 0.0000 | Skin-muscle | 0.0000 |
| Suprarenal gland | 0.0000 | Testicles | 0.0000 |
| Kidney | 0.0062 | Lung | 0.0082 |
| Placenta | 0.0000 | Nerves | 0.0020 |
| Prostate | 0.0000 | Prostate | 0.0000 |
| Sensory organs | 0.0000 | Sensory Organs | 0.0000 |
| | | Uterus_n | 0.0042 |

Electronic Northern for SEQ. ID NO.: 57

| | NORMAL % frequency | TUMOR % frequency | Ratios N/T | T/N |
|---|---|---|---|---|
| Bladder | 0.0078 | 0.0000 | undef | 0.0000 |
| Breast | 0.0038 | 0.0075 | 0.5104 | 1.9593 |
| Small intestine | 0.0031 | 0.0000 | undef | 0.0000 |
| Ovary | 0.0000 | 0.0078 | 0.0000 | undef |
| Endocrine tissue | 0.0000 | 0.0000 | undef | undef |
| Gastrointestinal | 0.0077 | 0.0185 | 0.4142 | 2.4145 |
| Brain | 0.0096 | 0.0000 | undef | 0.0000 |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0011 | 0.0000 | undef | 0.0000 |
| Testicles | 0.0000 | 0.0117 | 0.0000 | undef |
| Lung | 0.0010 | 0.0000 | undef | 0.0000 |
| Stomach-esophagus | 0.0000 | 0.0153 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0109 | 0.0085 | 1.2795 | 0.7815 |
| Uterus-endometrium | 0.0000 | 0.1583 | 0.0000 | undef |
| Uterus-myometrium | 0.0000 | 0.0000 | undef | undef |
| Uterus-general | 0.0000 | 0.1908 | 0.0000 | undef |
| Breast hyperplasia | 0.0032 | | | |
| Prostate hyperplasia | 0.0089 | | | |
| Seminal vesicle | 0.0000 | | | |
| Sensory organs | 0.0000 | | | |
| White blood cells | 0.0000 | | | |
| Cervix | 0.0106 | | | |

| | FETUS % frequency | STANDARDIZED/SUB-TRACTED LIBRARIES % frequency | |
|---|---|---|---|
| Development | 0.0000 | Breast | 0.0068 |
| Gastrointestinal | 0.0028 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0072 | Skin-muscle | 0.0000 |
| Suprarenal gland | 0.0000 | Testicles | 0.0000 |
| Kidney | 0.0124 | Lung | 0.0000 |
| Placenta | 0.0000 | Nerves | 0.0050 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 58

| | NORMAL % frequency | TUMOR % frequency | Ratios N/T | T/N |
|---|---|---|---|---|
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0017 | 0.0000 | undef | 0.0000 |
| Gastrointestinal | 0.0019 | 0.0000 | undef | 0.0000 |
| Brain | 0.0007 | 0.0000 | undef | 0.0000 |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.0000 | undef | undef |
| Uterus-myometrium | 0.0000 | 0.1055 | 0.0000 | undef |
| Uterus-general | 0.0000 | 0.0000 | undef | undef |
| Breast hyperplasia | 0.0000 | 0.0000 | undef | undef |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0028 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 59

| | NORMAL % frequency | TUMOR % frequency | Ratios N/T | T/N |
|---|---|---|---|---|
| Bladder | 0.0039 | 0.0026 | 1.5254 | 0.6555 |
| Breast | 0.0281 | 0.0226 | 1.2476 | 0.8015 |
| Small intestine | 0.0307 | 0.0000 | undef | 0.0000 |
| Ovary | 0.0000 | 0.0026 | 0.0000 | undef |
| Endocrine tissue | 0.0085 | 0.0000 | undef | 0.0000 |
| Gastrointestinal | 0.0153 | 0.0324 | 0.4733 | 2.1127 |
| Brain | 0.0044 | 0.0072 | 0.6171 | 1.6205 |

-continued

| | | | |
|---|---|---|---|
| Hematopoietic | 0.0053 | 0.0000 | undef | 0.0000 |
| Skin | 0.0257 | 0.0000 | undef | 0.0000 |
| Hepatic | 0.0048 | 0.0065 | 0.7353 | 1.3600 |
| Heart | 0.0032 | 0.0000 | undef | 0.0000 |
| Testicles | 0.0000 | 0.0000 | undef | undef |
| Lung | 0.0000 | 0.0061 | 0.0000 | undef |
| Stomach-esophagus | 0.0000 | 0.0153 | 0.0000 | undef |
| Muscle-skeleton | 0.0154 | 0.0180 | 0.8567 | 1.1673 |
| Kidney | 0.0217 | 0.0068 | 3.1722 | 0.3152 |
| Pancreas | 0.0000 | 0.0166 | 0.0000 | undef |
| Penis | 0.0030 | 0.0000 | undef | 0.0000 |
| Prostate | 0.0000 | 0.0021 | 0.0000 | undef |
| Uterus-endometrium | 0.0135 | 0.1055 | 0.1280 | 7.8106 |
| Uterus-myometrium | 0.0000 | 0.0000 | undef | undef |
| Uterus-general | 0.0000 | 0.0000 | undef | undef |
| Breast hyperplasia | 0.0128 | | | |
| Prostate hyperplasia | 0.0000 | | | |
| Seminal vesicle | 0.0000 | | | |
| Sensory organs | 0.0235 | | | |
| White blood cells | 0.0000 | | | |
| Cervix | 0.0106 | | | |

| | FETUS % frequency | STANDARDIZED/SUB-TRACTED LIBRARIES % frequency | |
|---|---|---|---|
| Development | 0.0139 | Breast | 0.0476 |
| Gastrointestinal | 0.0139 | Ovary_n | 0.0000 |
| Brain | 0.0000 | Ovary_t | 0.0101 |
| Hematopoietic | 0.0000 | Endocrine tissue | 0.0000 |
| Skin | 0.0000 | Fetal | 0.0151 |
| Hepatic | 0.0000 | Gastrointestinal | 0.0000 |
| Heart-blood vessels | 0.0000 | Hematopoietic | 0.0057 |
| Lung | 0.0181 | Skin-muscle | 0.0000 |
| Suprarenal gland | 0.0254 | Testicles | 0.0000 |
| Kidney | 0.0000 | Lung | 0.0082 |
| Placenta | 0.0303 | Nerves | 0.0050 |
| Prostate | 0.0000 | Prostate | 0.0137 |
| Sensory organs | 0.0000 | Sensory Organs | 0.0000 |
| | | Uterus_n | 0.0208 |

Electronic Northern for SEQ. ID NO.: 60

| | NORMAL % frequency | TUMOR % frequency | Ratios N/T | Ratios T/N |
|---|---|---|---|---|
| Bladder | 0.0156 | 0.0102 | 1.5254 | 0.6555 |
| Breast | 0.0115 | 0.0207 | 0.5568 | 1.7960 |
| Small intestine | 0.0215 | 0.0165 | 1.2976 | 0.7707 |
| Ovary | 0.0240 | 0.0260 | 0.9210 | 1.0858 |
| Endocrine tissue | 0.0119 | 0.0176 | 0.6792 | 1.4722 |
| Gastrointestinal | 0.0172 | 0.0139 | 1.2425 | 0.8048 |
| Brain | 0.0170 | 0.0246 | 0.6900 | 1.4494 |
| Hematopoietic | 0.0040 | 0.0000 | undef | 0.0000 |
| Skin | 0.0184 | 0.0000 | undef | 0.0000 |
| Hepatic | 0.0238 | 0.0194 | 1.2255 | 0.8160 |
| Heart | 0.0180 | 0.0275 | 0.6553 | 1.5260 |
| Testicles | 0.0058 | 0.0117 | 0.4920 | 2.0326 |
| Lung | 0.0156 | 0.0164 | 0.9526 | 1.0498 |
| Stomach-esophagus | 0.0193 | 0.0000 | undef | 0.0000 |
| Muscle-skeleton | 0.0103 | 0.0060 | 1.7133 | 0.5837 |
| Kidney | 0.0081 | 0.0411 | 0.1983 | 5.0439 |
| Pancreas | 0.0116 | 0.0055 | 2.0940 | 0.4775 |
| Penis | 0.0150 | 0.0267 | 0.5616 | 1.7807 |
| Prostate | 0.0131 | 0.0043 | 3.0709 | 0.3256 |
| Uterus-endometrium | 0.0135 | 0.1055 | 0.1280 | 7.8106 |
| Uterus-myometrium | 0.0000 | 0.0068 | 0.0000 | undef |
| Uterus-general | 0.0153 | 0.0000 | undef | 0.0000 |
| Breast hyperplasia | 0.0096 | | | |
| Prostate hyperplasia | 0.0059 | | | |
| Seminal vesicle | 0.0000 | | | |
| Sensory organs | 0.0118 | | | |
| White blood cells | 0.0061 | | | |
| Cervix | 0.0426 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0139 | Ovary_n | 0.0000 |
| Brain | 0.0125 | Ovary_t | 0.0000 |
| Hematopoietic | 0.0157 | Endocrine tissue | 0.0245 |
| Skin | 0.0000 | Fetal | 0.0151 |
| Hepatic | 0.0260 | Gastrointestinal | 0.0122 |
| Heart-blood vessels | 0.0213 | Hematopoietic | 0.0000 |
| Lung | 0.0036 | Skin-muscle | 0.0194 |
| Suprarenal gland | 0.0000 | Testicles | 0.0000 |
| Kidney | 0.0062 | Lung | 0.0246 |
| Placenta | 0.0061 | Nerves | 0.0211 |
| Prostate | 0.0000 | Prostate | 0.0274 |
| Sensory organs | 0.0126 | Sensory Organs | 0.0000 |
| | | Uterus_n | 0.0125 |

Electronic Northern for SEQ. ID NO.: 61

| | NORMAL % frequency | TUMOR % frequency | Ratios N/T | Ratios T/N |
|---|---|---|---|---|
| Bladder | 0.0000 | 0.0128 | 0.0000 | undef |
| Breast | 0.0000 | 0.0056 | 0.0000 | undef |
| Small intestine | 0.0061 | 0.0000 | undef | 0.0000 |
| Ovary | 0.0030 | 0.0000 | undef | 0.0000 |
| Endocrine tissue | 0.0119 | 0.0075 | 1.5849 | 0.6309 |
| Gastrointestinal | 0.0057 | 0.0000 | undef | 0.0000 |
| Brain | 0.0059 | 0.0072 | 0.8228 | 1.2153 |
| Hematopoietic | 0.0067 | 0.0000 | undef | 0.0000 |
| Skin | 0.0037 | 0.0000 | undef | 0.0000 |
| Hepatic | 0.0048 | 0.0129 | 0.3676 | 2.7200 |
| Heart | 0.0053 | 0.0000 | undef | 0.0000 |
| Testicles | 0.0058 | 0.0000 | undef | 0.0000 |
| Lung | 0.0031 | 0.0020 | 1.5241 | 0.6561 |
| Stomach-esophagus | 0.0193 | 0.0000 | undef | 0.0000 |
| Muscle-skeleton | 0.0017 | 0.0120 | 0.1428 | 7.0040 |
| Kidney | 0.0136 | 0.0000 | undef | 0.0000 |
| Pancreas | 0.0033 | 0.0276 | 0.1197 | 8.3571 |
| Penis | 0.0030 | 0.0000 | undef | 0.0000 |
| Prostate | 0.0153 | 0.0170 | 0.8957 | 1.1165 |
| Uterus-endometrium | 0.0068 | 0.1055 | 0.0640 | 15.6211 |
| Uterus-myometrium | 0.0000 | 0.0000 | undef | undef |
| Uterus-general | 0.0000 | 0.0000 | undef | undef |
| Breast hyperplasia | 0.0032 | | | |
| Prostate hyperplasia | 0.0030 | | | |
| Seminal vesicle | 0.0000 | | | |
| Sensory organs | 0.0000 | | | |
| White blood cells | 0.0026 | | | |
| Cervix | 0.0106 | | | |

| | FETUS % frequency | STANDARDIZED/SUB-TRACTED LIBRARIES % frequency | |
|---|---|---|---|
| Development | 0.0000 | Breast | 0.0136 |
| Gastrointestinal | 0.0083 | Ovary_n | 0.0000 |
| Brain | 0.0000 | Ovary_t | 0.0000 |
| Hematopoietic | 0.0039 | Endocrine tissue | 0.0000 |
| Skin | 0.0000 | Fetal | 0.0058 |
| Hepatic | 0.0000 | Gastrointestinal | 0.0122 |
| Heart-blood vessels | 0.0036 | Hematopoietic | 0.0057 |
| Lung | 0.0000 | Skin-muscle | 0.0000 |
| Suprarenal gland | 0.0000 | Testicles | 0.0154 |
| Kidney | 0.0124 | Lung | 0.0000 |
| Placenta | 0.0061 | Nerves | 0.0030 |
| Prostate | 0.0249 | Prostate | 0.0000 |
| Sensory organs | 0.0000 | Sensory Organs | 0.0000 |
| | | Uterus_n | 0.0000 |

-continued

Electronic Northern for SEQ. ID NO.: 62

|  | NORMAL | TUMOR | Ratios | |
|---|---|---|---|---|
|  | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0017 | 0.0000 | undef | 0.0000 |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.0000 | undef | undef |
| Uterus-myometrium | 0.0000 | 0.1055 | 0.0000 | undef |
| Uterus-general | 0.0000 | 0.0000 | undef | undef |
| Breast hyperplasia | 0.0000 | 0.0000 | undef | undef |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

|  | FETUS | STANDARDIZED/SUB-TRACTED LIBRARIES | |
|---|---|---|---|
|  | % frequency | | % frequency |
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0006 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
|  |  | Uterus_n | 0.0000 |

Electronic Northern for SEQ. ID NO.: 63

|  | NORMAL | TUMOR | Ratios | |
|---|---|---|---|---|
|  | % frequency | % frequency | N/T | T/N |
| Bladder | 0.0078 | 0.0051 | 1.5254 | 0.6555 |
| Breast | 0.0038 | 0.0094 | 0.4083 | 2.4491 |
| Small intestine | 0.0031 | 0.0331 | 0.0927 | 10.7893 |
| Ovary | 0.0150 | 0.0208 | 0.7195 | 1.3898 |
| Endocrine tissue | 0.0136 | 0.0100 | 1.3585 | 0.7361 |
| Gastrointestinal | 0.0230 | 0.0046 | 4.9700 | 0.2012 |
| Brain | 0.0096 | 0.0082 | 1.1699 | 0.8547 |
| Hematopoietic | 0.0094 | 0.0000 | undef | 0.0000 |
| Skin | 0.0110 | 0.0000 | undef | 0.0000 |
| Hepatic | 0.0000 | 0.0065 | 0.0000 | undef |
| Heart | 0.0053 | 0.0000 | undef | 0.0000 |
| Testicles | 0.0173 | 0.0000 | undef | 0.0000 |
| Lung | 0.0052 | 0.0041 | 1.2701 | 0.7873 |
| Stomach-esophagus | 0.0387 | 0.0077 | 5.0421 | 0.1983 |
| Muscle-skeleton | 0.0051 | 0.0120 | 0.4283 | 2.3347 |
| Kidney | 0.0081 | 0.0274 | 0.2974 | 2.3626 |
| Pancreas | 0.0083 | 0.0110 | 0.7479 | 1.3371 |
| Penis | 0.0150 | 0.0267 | 0.5616 | 1.7807 |
| Prostate | 0.0044 | 0.0043 | 1.0236 | 0.9769 |
| Uterus-endometrium | 0.0068 | 0.2111 | 0.0320 | 31.2422 |
| Uterus-myometrium | 0.0076 | 0.0068 | 1.1223 | 0.8911 |
| Uterus-general | 0.0051 | 0.0000 | undef | 0.0000 |
| Breast hyperplasia | 0.0256 | | | |
| Prostate hyperplasia | 0.0089 | | | |
| Seminal vesicle | 0.0000 | | | |
| Sensory organs | 0.0235 | | | |
| White blood cells | 0.0061 | | | |
| Cervix | 0.0000 | | | |

|  | FETUS | STANDARDIZED/SUB-TRACTED LIBRARIES | |
|---|---|---|---|
|  | % frequency | | % frequency |
| Development | 0.0278 | Breast | 0.0204 |
| Gastrointestinal | 0.0056 | Ovary_n | 0.1595 |
| Brain | 0.0000 | Ovary_t | 0.0000 |
| Hematopoietic | 0.0236 | Endocrine tissue | 0.0000 |
| Skin | 0.0000 | Fetal | 0.0047 |
| Hepatic | 0.0000 | Gastrointestinal | 0.0000 |
| Heart-blood vessels | 0.0356 | Hematopoietic | 0.0228 |
| Lung | 0.0289 | Skin-muscle | 0.0097 |
| Suprarenal gland | 0.0000 | Testicles | 0.0231 |
| Kidney | 0.0124 | Lung | 0.0000 |
| Placenta | 0.0000 | Nerves | 0.0100 |
| Prostate | 0.0000 | Prostate | 0.0000 |
| Sensory organs | 0.0628 | Sensory Organs | 0.0000 |
|  |  | Uterus_n | 0.0083 |

Electronic Northern for SEQ. ID NO.: 64

|  | NORMAL | TUMOR | Ratios | |
|---|---|---|---|---|
|  | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

|  | FETUS | STANDARDIZED/SUB-TRACTED LIBRARIES | |
|---|---|---|---|
|  | % frequency | | % frequency |
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |

Electronic Northern for SEQ. ID NO.: 65

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0019 | 0.0000 | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0007 | 0.0000 | undef | 0.0000 |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0244 | 0.0137 | 1.7843 | 0.5604 |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0041 |
| Hepatic | 0.0000 | Gastrointestinal | 0.0000 |
| Heart-blood vessels | 0.0000 | Hematopoietic | 0.0057 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 66

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 67

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0038 | 0.0000 | undef |
| Small intestine | 0.0031 | 0.0000 | undef | 0.0000 |
| Ovary | 0.0000 | 0.0052 | 0.0000 | undef |
| Endocrine tissue | 0.0034 | 0.0000 | undef | 0.0000 |
| Gastrointestinal | 0.0000 | 0.0000 | undef | undef |
| Brain | 0.0022 | 0.0010 | 2.1599 | 0.4630 |
| Hematopoietic | 0.0013 | 0.0000 | undef | 0.0000 |
| Skin | 0.0000 | 0.0000 | undef | undef |
| Hepatic | 0.0000 | 0.0000 | undef | undef |
| Heart | 0.0032 | 0.0000 | undef | 0.0000 |
| Testicles | 0.0058 | 0.0000 | undef | 0.0000 |
| Lung | 0.0010 | 0.0020 | 0.5080 | 1.9684 |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0030 | 0.0000 | undef | 0.0000 |
| Uterus-endometrium | 0.0044 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0009 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0039 | Endocrine tissue | 0.0000 |
| Skin | 0.0000 | Fetal | 0.0047 |
| Hepatic | 0.0000 | Gastrointestinal | 0.0000 |
| Heart-blood vessels | 0.0000 | Hematopoietic | 0.0000 |

-continued

| | | | | |
|---|---|---|---|---|
| Lung | 0.0000 | Skin-muscle | | 0.0097 |
| Suprarenal gland | 0.0000 | Testicles | | 0.0000 |
| Kidney | 0.0000 | Lung | | 0.0000 |
| Placenta | 0.0000 | Nerves | | 0.0000 |
| Prostate | 0.0000 | Prostate | | 0.0068 |
| Sensory organs | 0.0000 | Sensory Organs | | 0.0000 |
| | | Uterus_n | | 0.0125 |

Electronic Northern for SEQ. ID NO.: 68

| | NORMAL | TUMOR | Ratios | |
|---|---|---|---|---|
| | % frequency | % frequency | N/T | T/N |
| Bladder | 0.0078 | 0.0128 | 0.6102 | 1.6389 |
| Breast | 0.0038 | 0.0188 | 0.2042 | 4.8982 |
| Small intestine | 0.0153 | 0.0331 | 0.4634 | 2.1579 |
| Ovary | 0.0120 | 0.0208 | 0.5756 | 1.7372 |
| Endocrine tissue | 0.0136 | 0.0125 | 1.0868 | 0.9201 |
| Gastrointestinal | 0.0077 | 0.0000 | undef | 0.0000 |
| Brain | 0.0052 | 0.0041 | 1.2599 | 0.7937 |
| Hematopoietic | 0.0027 | 0.0000 | undef | 0.0000 |
| Skin | 0.0000 | 0.0847 | 0.0000 | undef |
| Hepatic | 0.0095 | 0.0194 | 0.4902 | 2.0400 |
| Heart | 0.0307 | 0.0275 | 1.1179 | 0.8945 |
| Testicles | 0.0000 | 0.0351 | 0.0000 | undef |
| Lung | 0.0042 | 0.0286 | 0.1452 | 6.8893 |
| Stomach-esophagus | 0.0000 | 0.0000 | undef | undef |
| Muscle-skeleton | 0.0051 | 0.0120 | 0.4283 | 2.3347 |
| Kidney | 0.0054 | 0.0137 | 0.3965 | 2.5219 |
| Pancreas | 0.0116 | 0.0110 | 1.0470 | 0.9551 |
| Penis | 0.0030 | 0.0000 | undef | 0.0000 |
| Prostate | 0.0044 | 0.0106 | 0.4095 | 2.4423 |
| Uterus-endometrium | 0.0135 | 0.1583 | 0.0854 | 11.7158 |
| Uterus-myometrium | 0.0076 | 0.0204 | 0.3741 | 2.6732 |
| Uterus-general | 0.0102 | 0.1908 | 0.0534 | 18.7357 |
| Breast hyperplasia | 0.0160 | | | |
| Prostate hyperplasia | 0.0119 | | | |
| Seminal vesicle | 0.0089 | | | |
| Sensory organs | 0.0000 | | | |
| White blood cells | 0.0130 | | | |
| Cervix | 0.0000 | | | |

| | FETUS | STANDARDIZED/SUB-TRACTED LIBRARIES | |
|---|---|---|---|
| | % frequency | % frequency | |
| Development | 0.0557 | Breast | 0.0000 |
| Gastrointestinal | 0.0194 | Ovary_n | 0.0000 |
| Brain | 0.0000 | Ovary_t | 0.0000 |
| Hematopoietic | 0.0079 | Endocrine tissue | 0.0245 |
| Skin | 0.0000 | Fetal | 0.0105 |
| Hepatic | 0.0000 | Gastrointestinal | 0.0122 |
| Heart-blood vessels | 0.0142 | Hematopoietic | 0.0000 |
| Lung | 0.0108 | Skin-muscle | 0.0421 |
| Suprarenal gland | 0.0254 | Testicles | 0.0077 |
| Kidney | 0.0000 | Lung | 0.0082 |
| Placenta | 0.0061 | Nerves | 0.0030 |
| Prostate | 0.0748 | Prostate | 0.0137 |
| Sensory organs | 0.0126 | Sensory Organs | 0.0000 |
| | | Uterus_n | 0.0083 |

Electronic Northern for SEQ. ID NO.: 69

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0030 | | | |
| Seminal vesicle | 0.0000 | | | |
| Sensory organs | 0.0000 | | | |
| White blood cells | 0.0000 | | | |
| Cervix | 0.0000 | | | |

| | FETUS | STANDARDIZED/SUB-TRACTED LIBRARIES | |
|---|---|---|---|
| | % frequency | % frequency | |
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0006 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0010 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 70

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0019 | 0.0000 | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS | STANDARDIZED/SUB-TRACTED LIBRARIES | |
|---|---|---|---|
| | % frequency | % frequency | |
| Development | 0.0000 | Breast | 0.0000 |
| Gastrointestinal | 0.0000 | Ovary_n | 0.0000 |
| Brain | 0.0000 | Ovary_t | 0.0000 |

| | | | | |
|---|---|---|---|---|
| Hematopoietic | 0.0000 | Endocrine tissue | 0.0000 | |
| Skin | 0.0000 | Fetal | 0.0000 | |
| Hepatic | 0.0000 | Gastrointestinal | 0.0000 | |
| Heart-blood vessels | 0.0000 | Hematopoietic | 0.0000 | |
| Lung | 0.0000 | Skin-muscle | 0.0000 | |
| Suprarenal gland | 0.0000 | Testicles | 0.0000 | |
| Kidney | 0.0000 | Lung | 0.0000 | |
| Placenta | 0.0000 | Nerves | 0.0000 | |
| Prostate | 0.0000 | Prostate | 0.0000 | |
| Sensory organs | 0.0000 | Sensory Organs | 0.0000 | |
| | | Uterus_n | 0.0000 | |

Electronic Northern for SEQ. ID NO.: 71

| | NORMAL | TUMOR | Ratios | |
|---|---|---|---|---|
| | % frequency | % frequency | N/T | T/N |
| Bladder | 0.0000 | 0.0230 | 0.0000 | undef |
| Breast | 0.0051 | 0.0056 | 0.9074 | 1.1021 |
| Small intestine | 0.0215 | 0.0000 | undef | 0.0000 |
| Ovary | 0.0060 | 0.0182 | 0.3289 | 3.0402 |
| Endocrine tissue | 0.0068 | 0.0000 | undef | 0.0000 |
| Gastrointestinal | 0.0728 | 0.0185 | 3.9346 | 0.2542 |
| Brain | 0.0000 | 0.0010 | 0.0000 | undef |
| Hematopoietic | 0.0027 | 0.0000 | undef | 0.0000 |
| Skin | 0.0000 | 0.0000 | undef | undef |
| Hepatic | 0.0048 | 0.0259 | 0.1838 | 5.4400 |
| Heart | 0.0011 | 0.0000 | undef | 0.0000 |
| Testicles | 0.0173 | 0.0000 | undef | 0.0000 |
| Lung | 0.0114 | 0.0061 | 1.8628 | 0.5368 |
| Stomach-esophagus | 0.0387 | 0.0000 | undef | 0.0000 |
| Muscle-skeleton | 0.0017 | 0.0000 | undef | 0.0000 |
| Kidney | 0.0081 | 0.0000 | undef | 0.0000 |
| Pancreas | 0.0033 | 0.0068 | 1.1896 | 0.8406 |
| Penis | 0.0000 | 0.0055 | 0.5983 | 1.6714 |
| Prostate | 0.0065 | 0.0000 | undef | undef |
| Uterus-endometrium | 0.0000 | 0.0106 | 0.6142 | 1.6282 |
| Uterus-myometrium | 0.0000 | 0.1055 | 0.0000 | undef |
| Uterus-general | 0.0000 | 0.0000 | undef | undef |
| Breast hyperplasia | 0.0000 | 0.0000 | undef | undef |
| Prostate hyperplasia | 0.0030 | | | |
| Seminal vesicle | 0.0089 | | | |
| Sensory organs | 0.0000 | | | |
| White blood cells | 0.0000 | | | |
| Cervix | 0.0000 | | | |

| | FETUS<br>% frequency | STANDARDIZED/SUB-<br>TRACTED LIBRARIES<br>% frequency | |
|---|---|---|---|
| Development | 0.0000 | Breast | 0.0136 |
| Gastrointestinal | 0.0083 | Ovary_n | 0.0000 |
| Brain | 0.0000 | Ovary_t | 0.0608 |
| Hematopoietic | 0.0000 | Endocrine tissue | 0.0000 |
| Skin | 0.0000 | Fetal | 0.0047 |
| Hepatic | 0.0000 | Gastrointestinal | 0.0000 |
| Heart-blood vessels | 0.0000 | Hematopoietic | 0.0000 |
| Lung | 0.0072 | Skin-muscle | 0.0000 |
| Suprarenal gland | 0.0000 | Testicles | 0.0000 |
| Kidney | 0.0062 | Lung | 0.0164 |
| Placenta | 0.0061 | Nerves | 0.0000 |
| Prostate | 0.0000 | Prostate | 0.0068 |
| Sensory organs | 0.0000 | Sensory Organs | 0.0000 |
| | | Uterus_n | 0.0000 |

Electronic Northern for SEQ. ID NO.: 72

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0026 | 0.0000 | undef |
| Endocrine tissue | 0.0000 | 0.0050 | 0.0000 | undef |
| Gastrointestinal | 0.0019 | 0.0000 | undef | 0.0000 |
| Brain | 0.0007 | 0.0000 | undef | 0.0000 |
| Hematopoietic | 0.0013 | 0.0000 | undef | 0.0000 |
| Skin | 0.0037 | 0.0000 | undef | 0.0000 |
| Hepatic | 0.0000 | 0.0000 | undef | undef |
| Heart | 0.0021 | 0.0000 | undef | 0.0000 |
| Testicles | 0.0000 | 0.0000 | undef | undef |
| Lung | 0.0010 | 0.0000 | undef | 0.0000 |
| Stomach-esophagus | 0.0000 | 0.0000 | undef | undef |
| Muscle-skeleton | 0.0034 | 0.0000 | undef | 0.0000 |
| Kidney | 0.0000 | 0.0000 | undef | undef |
| Pancreas | 0.0000 | 0.0000 | undef | undef |
| Penis | 0.0030 | 0.0000 | undef | 0.0000 |
| Prostate | 0.0000 | 0.0000 | undef | undef |
| Uterus-endometrium | 0.0068 | 0.2111 | 0.0320 | 31.2422 |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0030 | | | |
| Seminal vesicle | 0.0000 | | | |
| Sensory organs | 0.0000 | | | |
| White blood cells | 0.0000 | | | |
| Cervix | 0.0000 | | | |

| | FETUS<br>% frequency | STANDARDIZED/SUB-<br>TRACTED LIBRARIES<br>% frequency | |
|---|---|---|---|
| Development | 0.0000 | Breast | 0.0068 |
| Gastrointestinal | 0.0000 | Ovary_n | 0.0000 |
| Brain | 0.0063 | Ovary_t | 0.0051 |
| Hematopoietic | 0.0000 | Endocrine tissue | 0.0000 |
| Skin | 0.0000 | Fetal | 0.0047 |
| Hepatic | 0.0000 | Gastrointestinal | 0.0366 |
| Heart-blood vessels | 0.0036 | Hematopoietic | 0.0000 |
| Lung | 0.0000 | Skin-muscle | 0.0000 |
| Suprarenal gland | 0.0000 | Testicles | 0.0154 |
| Kidney | 0.0309 | Lung | 0.0000 |
| Placenta | 0.0000 | Nerves | 0.0040 |
| Prostate | 0.0000 | Prostate | 0.0000 |
| Sensory organs | 0.0000 | Sensory Organs | 0.0000 |
| | | Uterus_n | 0.0125 |

Electronic Northern for SEQ. ID NO.: 73

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0013 | 0.0019 | 0.6805 | 1.4694 |
| Small intestine | 0.0000 | 0.0165 | 0.0000 | undef |
| Ovary | 0.0000 | 0.0078 | 0.0000 | undef |
| Endocrine tissue | 0.0000 | 0.0000 | undef | undef |
| Gastrointestinal | 0.0019 | 0.0000 | undef | 0.0000 |
| Brain | 0.0007 | 0.0021 | 0.3600 | 2.7779 |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0021 | 0.0000 | undef | 0.0000 |
| Testicles | 0.0000 | 0.0234 | 0.0000 | undef |
| Lung | 0.0021 | 0.0061 | 0.3387 | 2.9526 |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0043 | 0.0000 | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0030 | | | |
| Seminal vesicle | 0.0000 | | | |
| Sensory organs | 0.0000 | | | |
| White blood cells | 0.0017 | | | |
| Cervix | 0.0000 | | | |

|  | FETUS % frequency | STANDARDIZED/SUB-TRACTED LIBRARIES % frequency |  |
|---|---|---|---|
| Development | 0.0000 | Breast | 0.0136 |
| Gastrointestinal | 0.0000 | Ovary_n | 0.0000 |
| Brain | 0.0063 | Ovary_t | 0.0000 |
| Hematopoietic | 0.0039 | Endocrine tissue | 0.0000 |
| Skin | 0.0000 | Fetal | 0.0029 |
| Hepatic | 0.0000 | Gastrointestinal | 0.0000 |
| Heart-blood vessels | 0.0071 | Hematopoietic | 0.0114 |
| Lung | 0.0072 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0010 |
| Prostate | 0.0000 | Prostate | 0.0137 |
| Sensory organs | 0.0000 | Sensory Organs | 0.0000 |
|  |  | Uterus_n | 0.0000 |

Electronic Northern for SEQ. ID NO.: 74

|  | NORMAL % frequency | TUMOR % frequency | Ratios N/T | Ratios T/N |
|---|---|---|---|---|
| Bladder | 0.0078 | 0.0051 | 1.5254 | 0.6555 |
| Breast | 0.0051 | 0.0075 | 0.6805 | 1.4694 |
| Small intestine | 0.0031 | 0.0000 | undef | 0.0000 |
| Ovary | 0.0090 | 0.0000 | undef | 0.0000 |
| Endocrine tissue | 0.0119 | 0.0125 | 0.9509 | 1.0516 |
| Gastrointestinal | 0.0057 | 0.0046 | 1.2425 | 0.8048 |
| Brain | 0.0059 | 0.0051 | 1.1519 | 0.8681 |
| Hematopoietic | 0.0187 | 0.0379 | 0.4940 | 2.0241 |
| Skin | 0.0000 | 0.0000 | undef | undef |
| Hepatic | 0.0000 | 0.0000 | undef | undef |
| Heart | 0.0085 | 0.0000 | undef | 0.0000 |
| Testicles | 0.0000 | 0.0117 | 0.0000 | undef |
| Lung | 0.0073 | 0.0041 | 1.7781 | 0.5624 |
| Stomach-esophagus | 0.0000 | 0.0077 | 0.0000 | undef |
| Muscle-skeleton | 0.0000 | 0.0120 | 0.0000 | undef |
| Kidney | 0.0000 | 0.0068 | 0.0000 | undef |
| Pancreas | 0.0033 | 0.0000 | undef | 0.0000 |
| Penis | 0.0030 | 0.0000 | undef | 0.0000 |
| Prostate | 0.0065 | 0.0043 | 1.5354 | 0.6513 |
| Uterus-endometrium | 0.0000 | 0.1583 | 0.0000 | undef |
| Uterus-myometrium | 0.0229 | 0.0000 | undef | 0.0000 |
| Uterus-general | 0.0204 | 0.0000 | undef | 0.0000 |
| Breast hyperplasia | 0.0000 |  |  |  |
| Prostate hyperplasia | 0.0000 |  |  |  |
| Seminal vesicle | 0.0089 |  |  |  |
| Sensory organs | 0.0000 |  |  |  |
| White blood cells | 0.0035 |  |  |  |
| Cervix | 0.0000 |  |  |  |

|  | FETUS % frequency | STANDARDIZED/SUB-TRACTED LIBRARIES % frequency |  |
|---|---|---|---|
| Development | 0.0000 | Breast | 0.0068 |
| Gastrointestinal | 0.0028 | Ovary_n | 0.0000 |
| Brain | 0.0000 | Ovary_t | 0.0000 |
| Hematopoietic | 0.0079 | Endocrine tissue | 0.0000 |
| Skin | 0.2513 | Fetal | 0.0023 |
| Hepatic | 0.0000 | Gastrointestinal | 0.0000 |
| Heart-blood vessels | 0.0000 | Hematopoietic | 0.0000 |
| Lung | 0.0072 | Skin-muscle | 0.0065 |
| Suprarenal gland | 0.0000 | Testicles | 0.0154 |
| Kidney | 0.0124 | Lung | 0.0246 |
| Placenta | 0.0061 | Nerves | 0.0010 |
| Prostate | 0.0000 | Prostate | 0.0000 |
| Sensory organs | 0.0000 | Sensory Organs | 0.0077 |
|  |  | Uterus_n | 0.0083 |

Electronic Northern for SEQ. ID NO.: 75

|  | NORMAL % frequency | TUMOR % frequency | Ratios N/T | Ratios T/N |
|---|---|---|---|---|
| Bladder | 0.0039 | 0.0051 | 0.7627 | 1.3111 |
| Breast | 0.0026 | 0.0038 | 0.6805 | 1.4694 |
| Small intestine | 0.0000 | 0.0000 | undef | undef |
| Ovary | 0.0090 | 0.0078 | 1.1513 | 0.8686 |
| Endocrine tissue | 0.0051 | 0.0075 | 0.6792 | 1.4722 |
| Gastrointestinal | 0.0019 | 0.0231 | 0.0828 | 12.0723 |
| Brain | 0.0089 | 0.0031 | 2.8798 | 0.3472 |
| Hematopoietic | 0.0027 | 0.0000 | undef | 0.0000 |
| Skin | 0.0000 | 0.0000 | undef | undef |
| Hepatic | 0.0048 | 0.0000 | undef | 0.0000 |
| Heart | 0.0032 | 0.0000 | undef | 0.0000 |
| Testicles | 0.0058 | 0.0000 | undef | 0.0000 |
| Lung | 0.0031 | 0.0061 | 0.5080 | 1.9684 |
| Stomach-esophagus | 0.0000 | 0.0077 | 0.0000 | undef |
| Muscle-skeleton | 0.0034 | 0.0060 | 0.5711 | 1.7510 |
| Kidney | 0.0054 | 0.0000 | undef | 0.0000 |
| Pancreas | 0.0000 | 0.0055 | 0.0000 | undef |
| Penis | 0.0090 | 0.0000 | undef | 0.0000 |
| Prostate | 0.0022 | 0.0043 | 0.5118 | 1.9538 |
| Uterus-endometrium | 0.0000 | 0.1055 | 0.0000 | undef |
| Uterus-myometrium | 0.0000 | 0.0068 | 0.0000 | undef |
| Uterus-general | 0.0051 | 0.0000 | undef | 0.0000 |
| Breast hyperplasia | 0.0032 |  |  |  |
| Prostate hyperplasia | 0.0030 |  |  |  |
| Seminal vesicle | 0.0000 |  |  |  |
| Sensory organs | 0.0000 |  |  |  |
| White blood cells | 0.0017 |  |  |  |
| Cervix | 0.0000 |  |  |  |

|  | FETUS % frequency | STANDARDIZED/SUB-TRACTED LIBRARIES % frequency |  |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0151 |
| Hepatic | 0.0000 | Gastrointestinal | 0.0000 |
| Heart-blood vessels | 0.0036 | Hematopoietic | 0.0114 |
| Lung | 0.0000 | Skin-muscle | 0.0130 |
| Suprarenal gland | 0.0254 | Testicles | 0.0000 |
| Kidney | 0.0000 | Lung | 0.0082 |
| Placenta | 0.0000 | Nerves | 0.0060 |
| Prostate | 0.0000 | Prostate | 0.0137 |
| Sensory organs | 0.0000 | Sensory Organs | 0.0000 |
|  |  | Uterus_n | 0.0208 |

Electronic Northern for SEQ. ID NO.: 76

|  | NORMAL % frequency | TUMOR % frequency | Ratios N/T | Ratios T/N |
|---|---|---|---|---|
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0020 | 0.0000 | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |

-continued

| | | | |
|---|---|---|---|
| Uterus-endometrium | 0.0000 | 0.2111 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 77

| | NORMAL % frequency | TUMOR % frequency | Ratios N/T | T/N |
|---|---|---|---|---|
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 78

| | NORMAL % frequency | TUMOR % frequency | Ratios N/T | T/N |
|---|---|---|---|---|
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1583 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0213 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 79

| | NORMAL % frequency | TUMOR % frequency | Ratios N/T | T/N |
|---|---|---|---|---|
| Bladder | 0.0000 | 0.0000 | undef | undef |
| Breast | 0.0013 | 0.0000 | undef | 0.0000 |
| Small intestine | 0.0000 | 0.0000 | undef | undef |
| Ovary | 0.0030 | 0.0000 | undef | 0.0000 |
| Endocrine tissue | 0.0017 | 0.0050 | 0.3396 | 2.9444 |
| Gastrointestinal | 0.0019 | 0.0000 | undef | 0.0000 |
| Brain | 0.0007 | 0.0031 | 0.2400 | 4.1669 |
| Hematopoietic | 0.0000 | 0.0000 | undef | undef |
| Skin | 0.0000 | 0.0000 | undef | undef |
| Hepatic | 0.0048 | 0.0129 | 0.3676 | 2.7200 |
| Heart | 0.0000 | 0.0000 | undef | undef |
| Testicles | 0.0000 | 0.0000 | undef | undef |
| Lung | 0.0000 | 0.0020 | 0.0000 | undef |
| Stomach-esophagus | 0.0000 | 0.0000 | undef | undef |
| Muscle-skeleton | 0.0034 | 0.0000 | undef | 0.0000 |

-continued

| | | | |
|---|---|---|---|
| Kidney | 0.0000 | 0.0000 | undef | undef |
| Pancreas | 0.0000 | 0.0055 | 0.0000 | undef |
| Penis | 0.0000 | 0.0000 | undef | undef |
| Prostate | 0.0044 | 0.0021 | 2.0473 | 0.4885 |
| Uterus-endometrium | 0.0000 | 0.1583 | 0.0000 | undef |
| Uterus myometrium | 0.0000 | 0.0068 | 0.0000 | undef |
| Uterus-general | 0.0000 | 0.0000 | undef | undef |
| Breast hyperplasia | 0.0032 | | | |
| Prostate hyperplasia | 0.0000 | | | |
| Seminal vesicle | 0.0000 | | | |
| Sensory organs | 0.0118 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0278 | Breast | 0.0068 |
| Gastrointestinal | 0.0056 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0164 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0042 |

Electronic Northern for SEQ. ID NO.: 80

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0013 | 0.0000 | undef | 0.0000 |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0055 | 0.0000 | undef |
| Penis | 0.0000 | 0.0000 | undef | undef |
| Prostate | 0.0000 | 0.0000 | undef | undef |
| Uterus-endometrium | 0.0000 | 0.1583 | 0.0000 | undef |
| Uterus-myometrium | 0.0000 | 0.0068 | 0.0000 | undef |
| Uterus-general | 0.0000 | 0.0000 | undef | undef |
| Breast hyperplasia | 0.0032 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0278 | Breast | 0.0068 |
| Gastrointestinal | 0.0028 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0042 |

Electronic Northern for SEQ. ID NO.: 81

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 82

| | NORMAL | TUMOR | Ratios | |
|---|---|---|---|---|
| | % frequency | % frequency | N/T | T/N |
| Bladder | 0.0000 | 0.0051 | 0.0000 | undef |
| Breast | 0.0077 | 0.0150 | 0.5104 | 1.9593 |
| Small intestine | 0.0184 | 0.0000 | undef | 0.0000 |
| Ovary | 0.0090 | 0.0208 | 0.4317 | 2.3163 |
| Endocrine tissue | 0.0068 | 0.0150 | 0.4528 | 2.2083 |
| Gastrointestinal | 0.0268 | 0.0231 | 1.1597 | 0.8623 |
| Brain | 0.0081 | 0.0123 | 0.6600 | 1.5152 |
| Hematopoietic | 0.0027 | 0.0000 | undef | 0.0000 |
| Skin | 0.0000 | 0.0000 | undef | undef |
| Hepatic | 0.0095 | 0.0065 | 1.4706 | 0.6800 |
| Heart | 0.0011 | 0.0412 | 0.0257 | 38.9113 |

|   |   |   |   |
|---|---|---|---|
| Testicles | 0.0058 | 0.0000 | undef | 0.0000 |
| Lung | 0.0031 | 0.0123 | 0.2540 | 3.9367 |
| Stomach-esophagus | 0.0290 | 0.0000 | undef | 0.0000 |
| Muscle-skeleton | 0.0103 | 0.0060 | 1.7133 | 0.5837 |
| Kidney | 0.0054 | 0.0000 | undef | 0.0000 |
| Pancreas | 0.0050 | 0.0166 | 0.2991 | 3.3428 |
| Penis | 0.0060 | 0.0000 | undef | 0.0000 |
| Prostate | 0.0305 | 0.0554 | 0.5512 | 1.8143 |
| Uterus-endometrium | 0.0000 | 0.1055 | 0.0000 | undef |
| Uterus-myometrium | 0.0000 | 0.0000 | undef | undef |
| Uterus-general | 0.0051 | 0.0000 | undef | 0.0000 |
| Breast hyperplasia | 0.0032 | | | |
| Prostate hyperplasia | 0.0119 | | | |
| Seminal vesicle | 0.0000 | | | |
| Sensory organs | 0.0000 | | | |
| White blood cells | 0.0026 | | | |
| Cervix | 0.0000 | | | |

|   | FETUS % frequency | STANDARDIZED/SUB-TRACTED LIBRARIES % frequency |   |
|---|---|---|---|
| Development | 0.0139 | Breast | 0.0136 |
| Gastrointestinal | 0.0028 | Ovary_n | 0.0000 |
| Brain | 0.0125 | Ovary_t | 0.0253 |
| Hematopoietic | 0.0039 | Endocrine tissue | 0.0000 |
| Skin | 0.0000 | Fetal | 0.0070 |
| Hepatic | 0.0000 | Gastrointestinal | 0.0122 |
| Heart-blood vessels | 0.0036 | Hematopoietic | 0.0000 |
| Lung | 0.0000 | Skin-muscle | 0.0097 |
| Suprarenal gland | 0.0507 | Testicles | 0.0000 |
| Kidney | 0.0000 | Lung | 0.0082 |
| Placenta | 0.0000 | Nerves | 0.0131 |
| Prostate | 0.0000 | Prostate | 0.0205 |
| Sensory organs | 0.0000 | Sensory Organs | 0.0000 |
| | | Uterus_n | 0.0083 |

Electronic Northern for SEQ. ID NO.: 83

|   | NORMAL | TUMOR | Ratios | |
|---|---|---|---|---|
|   | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

|   | FETUS % frequency | STANDARDIZED/SUB-TRACTED LIBRARIES % frequency |   |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0050 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 84

|   | NORMAL | TUMOR | Ratios | |
|---|---|---|---|---|
|   | % frequency | % frequency | N/T | T/N |
| Bladder | 0.0000 | 0.0000 | undef | undef |
| Breast | 0.0000 | 0.0019 | 0.0000 | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0022 | 0.0000 | undef | 0.0000 |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

|   | FETUS % frequency | STANDARDIZED/SUB-TRACTED LIBRARIES % frequency |   |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0006 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0254 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 85

|   | NORMAL | TUMOR | Ratios | |
|---|---|---|---|---|
|   | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |

-continued

| | | | |
|---|---|---|---|
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1583 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 86

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1583 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0068 |
| Sensory organs | 0.0000 | Sensory Organs | 0.0000 |
| | | Uterus_n | 0.0000 |

Electronic Northern for SEQ. ID NO.: 87

| | NORMAL | TUMOR | Ratios | |
|---|---|---|---|---|
| | % frequency | % frequency | N/T | T/N |
| Bladder | 0.0039 | 0.0204 | 0.1907 | 5.2444 |
| Breast | 0.0128 | 0.0075 | 1.7013 | 0.5878 |
| Small intestine | 0.0123 | 0.0165 | 0.7415 | 1.3487 |
| Ovary | 0.0030 | 0.0078 | 0.3838 | 2.6058 |
| Endocrine tissue | 0.0000 | 0.0000 | undef | undef |
| Gastrointestinal | 0.0038 | 0.0139 | 0.2761 | 3.6217 |
| Brain | 0.0007 | 0.0000 | undef | 0.0000 |
| Hematopoietic | 0.0000 | 0.0000 | undef | undef |
| Skin | 0.0110 | 0.0000 | undef | 0.0000 |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0031 | 0.0000 | undef | undef |
| Stomach-esophagus | 0.0097 | 0.0000 | undef | 0.0000 |
| Muscle-skeleton | 0.0000 | 0.0077 | 1.2605 | 0.7933 |
| Kidney | 0.0054 | 0.0000 | undef | undef |
| Pancreas | 0.0050 | 0.0000 | undef | 0.0000 |
| Penis | 0.0000 | 0.0000 | undef | 0.0000 |
| Prostate | 0.0044 | 0.0000 | undef | undef |
| Uterus-endometrium | 0.0068 | 0.0149 | 0.2925 | 3.4192 |
| Uterus-myometrium | 0.0000 | 0.1055 | 0.0640 | 15.6211 |
| Uterus-general | 0.0000 | 0.0000 | undef | undef |
| Breast hyperplasia | 0.0192 | 0.0000 | undef | undef |
| Prostate hyperplasia | 0.0089 | | | |
| Seminal vesicle | 0.0089 | | | |
| Sensory organs | 0.0000 | | | |
| White blood cells | 0.0000 | | | |
| Cervix | 0.0106 | | | |

| | FETUS % frequency | STANDARDIZED/SUB-TRACTED LIBRARIES % frequency | |
|---|---|---|---|
| Development | 0.0000 | Breast | 0.0068 |
| Gastrointestinal | 0.0000 | Ovary_n | 0.0000 |
| Brain | 0.0000 | Ovary_t | 0.0051 |
| Hematopoietic | 0.0000 | Endocrine tissue | 0.0000 |
| Skin | 0.0000 | Fetal | 0.0000 |
| Hepatic | 0.0000 | Gastrointestinal | 0.0122 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0082 |
| Placenta | 0.0000 | Nerves | 0.0000 |
| Prostate | 0.0000 | Prostate | 0.0068 |
| Sensory organs | 0.0000 | Sensory Organs | 0.0000 |
| | | Uterus_n | 0.0000 |

-continued

Electronic Northern for SEQ. ID NO.: 88

| | NORMAL | TUMOR | Ratios | |
| --- | --- | --- | --- | --- |
| | % frequency | % frequency | N/T | T/N |
| Bladder | 0.0000 | 0.0026 | 0.0000 | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0050 | 0.0000 | undef |
| Gastrointestinal | 0.0019 | 0.0000 | undef | 0.0000 |
| Brain | 0.0007 | 0.0010 | 0.7200 | 1.3890 |
| Hematopoietic | 0.0000 | 0.0000 | undef | undef |
| Skin | 0.0000 | 0.0000 | undef | undef |
| Hepatic | 0.0048 | 0.0000 | undef | 0.0000 |
| Heart | 0.0011 | 0.0000 | undef | 0.0000 |
| Testicles | 0.0000 | 0.0000 | undef | undef |
| Lung | 0.0000 | 0.0020 | 0.0000 | undef |
| Stomach-esophagus | 0.0000 | 0.0000 | undef | undef |
| Muscle-skeleton | 0.0017 | 0.0000 | undef | 0.0000 |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0021 | 0.0000 | undef |
| Uterus-endometrium | 0.0068 | 0.1055 | 0.0640 | 15.6211 |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0118 | | | |
| White blood cells | 0.0017 | | | |
| Cervix | 0.0000 | | | |

| | FETUS % frequency | STANDARDIZED/SUB-TRACTED LIBRARIES % frequency | |
| --- | --- | --- | --- |
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0006 |
| Hepatic | 0.0000 | Gastrointestinal | 0.0000 |
| Heart-blood vessels | 0.0000 | Hematopoietic | 0.0114 |
| Lung | 0.0036 | Skin-muscle | 0.0032 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 89

| | NORMAL | TUMOR | Ratios | |
| --- | --- | --- | --- | --- |
| | % frequency | % frequency | N/T | T/N |
| Bladder | 0.0000 | 0.0000 | undef | undef |
| Breast | 0.0013 | 0.0000 | undef | 0.0000 |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0055 | 0.0000 | undef |
| Penis | 0.0000 | 0.0000 | undef | undef |
| Prostate | 0.0000 | 0.0000 | undef | undef |
| Uterus-endometrium | 0.0000 | 0.1583 | 0.0000 | undef |
| Uterus-myometrium | 0.0000 | 0.0068 | 0.0000 | undef |
| Uterus-general | 0.0000 | 0.0000 | undef | undef |
| Breast hyperplasia | 0.0032 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
| --- | --- | --- | --- |
| Development | 0.0287 | Breast | 0.0068 |
| Gastrointestinal | 0.0028 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0042 |

Electronic Northern for SEQ. ID NO.: 90

| | NORMAL | TUMOR | Ratios | |
| --- | --- | --- | --- | --- |
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
| --- | --- | --- | --- |
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0039 | Endocrine tissue | 0.0000 |
| Skin | 0.0000 | Fetal | 0.0006 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |

-continued

| | | | | |
|---|---|---|---|---|
| Prostate | 0.0000 | Prostate | | 0.0000 |
| Sensory organs | 0.0000 | Sensory Organs | | 0.0000 |
| | | Uterus_n | | 0.0000 |

Electronic Northern for SEQ. ID NO.: 91

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0090 | 0.0038 | 2.3818 | 0.4198 |
| Small intestine | 0.0000 | 0.0000 | undef | undef |
| Ovary | 0.0030 | 0.0052 | 0.5756 | 1.7372 |
| Endocrine tissue | 0.0034 | 0.0025 | 1.3585 | 0.7361 |
| Gastrointestinal | 0.0096 | 0.0000 | undef | 0.0000 |
| Brain | 0.0037 | 0.0021 | 1.7999 | 0.5556 |
| Hematopoietic | 0.0027 | 0.0000 | undef | 0.0000 |
| Skin | 0.0110 | 0.0847 | 0.1300 | 7.6946 |
| Hepatic | 0.0095 | 0.0065 | 1.4706 | 0.6800 |
| Heart | 0.0042 | 0.0000 | undef | 0.0000 |
| Testicles | 0.0000 | 0.0117 | 0.0000 | undef |
| Lung | 0.0010 | 0.0020 | 0.5080 | 1.9684 |
| Stomach-esophagus | 0.0000 | 0.0077 | 0.0000 | undef |
| Muscle-skeleton | 0.0000 | 0.0000 | undef | undef |
| Kidney | 0.0027 | 0.0000 | undef | 0.0000 |
| Pancreas | 0.0017 | 0.0166 | 0.0997 | 10.0285 |
| Penis | 0.0030 | 0.0000 | undef | 0.0000 |
| Prostate | 0.0000 | 0.0021 | 0.0000 | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0118 | | | |
| White blood cells | 0.0026 | | | |
| Cervix | 0.0106 | | | |

| | FETUS % frequency | STANDARDIZED/SUB-TRACTED LIBRARIES % frequency | |
|---|---|---|---|
| Development | 0.0139 | Breast | 0.0000 |
| Gastrointestinal | 0.0111 | Ovary_n | 0.0000 |
| Brain | 0.0063 | Ovary_t | 0.0000 |
| Hematopoietic | 0.0000 | Endocrine tissue | 0.0000 |
| Skin | 0.0000 | Fetal | 0.0041 |
| Hepatic | 0.0000 | Gastrointestinal | 0.0000 |
| Heart-blood vessels | 0.0036 | Hematopoietic | 0.0057 |
| Lung | 0.0108 | Skin-muscle | 0.0065 |
| Suprarenal gland | 0.0000 | Testicles | 0.0000 |
| Kidney | 0.0000 | Lung | 0.0000 |
| Placenta | 0.0061 | Nerves | 0.0050 |
| Prostate | 0.0249 | Prostate | 0.0000 |
| Sensory organs | 0.0000 | Sensory Organs | 0.0000 |
| | | Uterus_n | 0.0125 |

Electronic Northern for SEQ. ID NO.: 92

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0025 | 0.0000 | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0017 | 0.0000 | undef | 0.0000 |
| Penis | 0.0000 | 0.0000 | undef | undef |
| Prostate | 0.0000 | 0.0000 | undef | undef |
| Uterus-endometrium | 0.0000 | 0.1583 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 93

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0019 | 0.0000 | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0011 | 0.0000 | undef | 0.0000 |
| Testicles | 0.0000 | 0.0000 | undef | undef |
| Lung | 0.0000 | 0.0020 | 0.0000 | undef |
| Stomach-esophagus | 0.0000 | 0.0000 | undef | undef |
| Muscle-skeleton | 0.0000 | 0.0060 | 0.0000 | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0021 | 0.0000 | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0012 |
| Hepatic | 0.0000 | Gastrointestinal | 0.0000 |
| Heart-blood vessels | 0.0000 | Hematopoietic | 0.0000 |

-continued

| | | | | |
|---|---|---|---|---|
| Lung | 0.0000 | Skin-muscle | | 0.0000 |
| Suprarenal gland | 0.0000 | Testicles | | 0.0000 |
| Kidney | 0.0000 | Lung | | 0.0000 |
| Placenta | 0.0000 | Nerves | | 0.0000 |
| Prostate | 0.0000 | Prostate | | 0.0000 |
| Sensory organs | 0.0000 | Sensory Organs | | 0.0000 |
| | | Uterus_n | | 0.0000 |

Electronic Northern for SEQ. ID NO.: 94

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0013 | 0.0000 | undef | 0.0000 |
| Small intestine | 0.0000 | 0.0165 | 0.0000 | undef |
| Ovary | 0.0000 | 0.0000 | undef | undef |
| Endocrine tissue | 0.0051 | 0.0075 | 0.6792 | 1.4722 |
| Gastrointestinal | 0.0000 | 0.0000 | undef | undef |
| Brain | 0.0022 | 0.0010 | 2.1599 | 0.4630 |
| Hematopoietic | 0.0000 | 0.0000 | undef | undef |
| Skin | 0.0037 | 0.0000 | undef | 0.0000 |
| Hepatic | 0.0000 | 0.0065 | 0.0000 | undef |
| Heart | 0.0021 | 0.0000 | undef | 0.0000 |
| Testicles | 0.0115 | 0.0000 | undef | 0.0000 |
| Lung | 0.0010 | 0.0020 | 0.5080 | 1.9684 |
| Stomach-esophagus | 0.0000 | 0.0000 | undef | undef |
| Muscle-skeleton | 0.0034 | 0.0000 | undef | 0.0000 |
| Kidney | 0.0000 | 0.0000 | undef | undef |
| Pancreas | 0.0000 | 0.0000 | undef | undef |
| Penis | 0.0030 | 0.0000 | undef | 0.0000 |
| Prostate | 0.0044 | 0.0000 | undef | 0.0000 |
| Uterus-endometrium | 0.0000 | 0.1055 | 0.0000 | undef |
| Uterus-myometrium | 0.0076 | 0.0136 | 0.5611 | 1.7821 |
| Uterus-general | 0.0051 | 0.0000 | undef | 0.0000 |
| Breast hyperplasia | 0.0000 | | | |
| Prostate hyperplasia | 0.0000 | | | |
| Seminal vesicle | 0.0089 | | | |
| Sensory organs | 0.0000 | | | |
| White blood cells | 0.0000 | | | |
| Cervix | 0.0000 | | | |

| | FETUS | STANDARDIZED/SUB-TRACTED LIBRARIES | |
|---|---|---|---|
| | % frequency | | % frequency |
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.2513 | Fetal | 0.0029 |
| Hepatic | 0.0000 | Gastrointestinal | 0.0000 |
| Heart-blood vessels | 0.0107 | Hematopoietic | 0.0000 |
| Lung | 0.0036 | Skin-muscle | 0.0065 |
| Suprarenal gland | 0.0000 | Testicles | 0.0154 |
| Kidney | 0.0000 | Lung | 0.0000 |
| Placenta | 0.0121 | Nerves | 0.0010 |
| Prostate | 0.0000 | Prostate | 0.0000 |
| Sensory organs | 0.0000 | Sensory Organs | 0.0000 |
| | | Uterus_n | 0.0208 |

Electronic Northern for SEQ. ID NO.: 95

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0025 | 0.0000 | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.0000 | undef | undef |
| Uterus-myometrium | 0.0000 | 0.1055 | 0.0000 | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS | STANDARDIZED/SUB-TRACTED LIBRARIES | |
|---|---|---|---|
| | % frequency | | % frequency |
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 96

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0030 | 0.0000 | undef | 0.0000 |
| Endocrine tissue | 0.0017 | 0.0000 | undef | 0.0000 |
| Gastrointestinal | 0.0000 | 0.0000 | undef | undef |
| Brain | 0.0007 | 0.0000 | undef | 0.0000 |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0022 | 0.0000 | undef | 0.0000 |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0009 | | | |
| Cervix | 0.0000 | | | |

| | FETUS | STANDARDIZED/SUB-TRACTED LIBRARIES | |
|---|---|---|---|
| | % frequency | | % frequency |
| Development | 0.0000 | Breast | 0.0000 |
| Gastrointestinal | 0.0000 | Ovary_n | 0.0000 |
| Brain | 0.0000 | Ovary_t | 0.0000 |

Electronic Northern for SEQ. ID NO.: 97

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0013 | 0.0019 | 0.6805 | 1.4694 |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0022 | 0.0000 | undef | 0.0000 |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0117 | 0.0000 | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0055 | 0.0000 | undef |
| Penis | 0.0000 | 0.0000 | undef | undef |
| Prostate | 0.0000 | 0.0000 | undef | undef |
| Uterus-endometrium | 0.0000 | 0.1583 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0009 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0010 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 98

| | NORMAL | TUMOR | Ratios | |
|---|---|---|---|---|
| | % frequency | % frequency | N/T | T/N |
| Bladder | 0.0000 | 0.0026 | 0.0000 | undef |
| Breast | 0.0000 | 0.0000 | undef | undef |
| Small intestine | 0.0000 | 0.0000 | undef | undef |
| Ovary | 0.0030 | 0.0026 | 1.1513 | 0.8686 |
| Endocrine tissue | 0.0000 | 0.0000 | undef | undef |
| Gastrointestinal | 0.0038 | 0.0000 | undef | 0.0000 |
| Brain | 0.0000 | 0.0000 | undef | undef |
| Hematopoietic | 0.0040 | 0.0000 | undef | 0.0000 |
| Skin | 0.0330 | 0.0000 | undef | 0.0000 |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0055 | 0.0000 | undef |
| Penis | 0.0000 | 0.0533 | 0.0000 | undef |
| Prostate | 0.0022 | 0.0021 | 1.0236 | 0.9769 |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0064 | | | |
| Prostate hyperplasia | 0.0000 | | | |
| Seminal vesicle | 0.0000 | | | |
| Sensory organs | 0.0000 | | | |
| White blood cells | 0.0017 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0063 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0030 |
| Prostate | 0.0000 | Prostate | 0.0000 |
| Sensory organs | 0.0000 | Sensory Organs | 0.0000 |
| | | Uterus_n | 0.0083 |

Electronic Northern for SEQ. ID NO.: 99

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1583 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

|  | FETUS % frequency | STANDARDIZED/SUB-TRACTED LIBRARIES % frequency |  |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0057 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
|  |  | Uterus_n | 0.0000 |

Electronic Northern for SEQ. ID NO.: 100

|  | NORMAL | TUMOR | Ratios | |
|---|---|---|---|---|
|  | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0051 | 0.0025 | 2.0377 | 0.4907 |
| Gastrointestinal | 0.0000 | 0.0000 | undef | undef |
| Brain | 0.0022 | 0.0010 | 2.1599 | 0.4630 |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0032 | 0.0000 | undef | 0.0000 |
| Testicles | 0.0000 | 0.0000 | undef | undef |
| Lung | 0.0052 | 0.0020 | 2.5402 | 0.3937 |
| Stomach-esophagus | 0.0000 | 0.0000 | undef | undef |
| Muscle-skeleton | 0.0000 | 0.0000 | undef | undef |
| Kidney | 0.0027 | 0.0000 | undef | 0.0000 |
| Pancreas | 0.0000 | 0.0000 | undef | undef |
| Penis | 0.0030 | 0.0000 | undef | 0.0000 |
| Prostate | 0.0000 | 0.0000 | undef | undef |
| Uterus-endometrium | 0.0000 | 0.1055 | 0.0000 | undef |
| Uterus-myometrium | 0.0000 | 0.0068 | 0.0000 | undef |
| Uterus-general | 0.0000 | 0.0000 | undef | undef |
| Breast hyperplasia | 0.0032 |  |  |  |
| Prostate hyperplasia | 0.0000 |  |  |  |
| Seminal vesicle | 0.0089 |  |  |  |
| Sensory organs | 0.0000 |  |  |  |
| White blood cells | 0.0009 |  |  |  |
| Cervix | 0.0000 |  |  |  |

|  | FETUS % frequency | STANDARDIZED/SUB-TRACTED LIBRARIES % frequency |  |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0036 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0061 | Nerves | 0.0000 |
| Prostate | 0.0000 | Prostate | 0.0000 |
| Sensory organs | 0.0000 | Sensory Organs | 0.0000 |
|  |  | Uterus_n | 0.0000 |

Electronic Northern for SEQ. ID NO.: 101

|  | NORMAL | TUMOR | Ratios | |
|---|---|---|---|---|
|  | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1583 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 |  |  |  |
| Prostate hyperplasia | 0.0000 |  |  |  |
| Seminal vesicle | 0.0000 |  |  |  |
| Sensory organs | 0.0000 |  |  |  |
| White blood cells | 0.0000 |  |  |  |
| Cervix | 0.0000 |  |  |  |

|  | FETUS % frequency | STANDARDIZED/SUB-TRACTED LIBRARIES % frequency |  |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
|  |  | Uterus_n | 0.0000 |

Electronic Northern for SEQ. ID NO.: 102

|  | NORMAL | TUMOR | Ratios | |
|---|---|---|---|---|
|  | % frequency | % frequency | N/T | T/N |
| Bladder | 0.0039 | 0.0000 | undef | 0.0000 |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0037 | 0.0000 | undef | 0.0000 |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |

-continued

| | | | | |
|---|---|---|---|---|
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS<br>% frequency | STANDARDIZED/SUB-<br>TRACTED LIBRARIES<br>% frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 103

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0064 | 0.0000 | undef | 0.0000 |
| Small intestine | 0.0000 | 0.0165 | 0.0000 | undef |
| Ovary | 0.0000 | 0.0078 | 0.0000 | undef |
| Endocrine tissue | 0.0000 | 0.0025 | 0.0000 | undef |
| Gastrointestinal | 0.0000 | 0.0000 | undef | undef |
| Brain | 0.0015 | 0.0021 | 0.7200 | 1.3890 |
| Hematopoietic | 0.0013 | 0.0000 | undef | 0.0000 |
| Skin | 0.0000 | 0.0000 | undef | undef |
| Hepatic | 0.0000 | 0.0000 | undef | undef |
| Heart | 0.0032 | 0.0000 | undef | 0.0000 |
| Testicles | 0.0000 | 0.0000 | undef | undef |
| Lung | 0.0010 | 0.0041 | 0.2540 | 3.9367 |
| Stomach-esophagus | 0.0000 | 0.0077 | 0.0000 | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0022 | 0.0000 | undef | 0.0000 |
| Uterus-endometrium | 0.0000 | 0.1055 | 0.0000 | undef |
| Uterus-myometrium | 0.0000 | 0.0068 | 0.0000 | undef |
| Uterus-general | 0.0051 | 0.0000 | undef | 0.0000 |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS<br>% frequency | STANDARDIZED/SUB-<br>TRACTED LIBRARIES<br>% frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0032 |
| Lung | 0.0000 | Skin-muscle | 0.0000 |
| Suprarenal gland | 0.0000 | Testicles | 0.0000 |
| Kidney | 0.0000 | Lung | 0.0040 |
| Placenta | 0.0000 | Nerves | 0.0000 |
| Prostate | 0.0249 | Prostate | 0.0000 |
| Sensory organs | 0.0000 | Sensory Organs | 0.0000 |
| | | Uterus_n | 0.0000 |

Electronic Northern for SEQ. ID NO.: 104

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0025 | 0.0000 | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0011 | 0.0000 | undef | 0.0000 |
| Testicles | 0.0000 | 0.0000 | undef | undef |
| Lung | 0.0010 | 0.0020 | 0.5080 | 1.9684 |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS<br>% frequency | STANDARDIZED/SUB-<br>TRACTED LIBRARIES<br>% frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 105

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0090 | 0.0038 | 2.3818 | 0.4198 |
| Small intestine | 0.0000 | 0.0000 | undef | undef |
| Ovary | 0.0030 | 0.0052 | 0.5756 | 1.7372 |
| Endocrine tissue | 0.0034 | 0.0025 | 1.3585 | 0.7361 |
| Gastrointestinal | 0.0096 | 0.0000 | undef | 0.0000 |
| Brain | 0.0037 | 0.0021 | 0.7999 | 0.5556 |
| Hematopoietic | 0.0027 | 0.0000 | undef | 0.0000 |
| Skin | 0.0110 | 0.0847 | 0.1300 | 7.6946 |
| Hepatic | 0.0095 | 0.0065 | 1.4706 | 0.6800 |
| Heart | 0.0042 | 0.0000 | undef | 0.0000 |
| Testicles | 0.0000 | 0.0117 | 0.0000 | undef |
| Lung | 0.0010 | 0.0020 | 0.5080 | 1.9684 |
| Stomach-esophagus | 0.0000 | 0.0077 | 0.0000 | undef |
| Muscle-skeleton | 0.0000 | 0.0000 | undef | undef |

-continued

| | | | | |
|---|---|---|---|---|
| Kidney | 0.0027 | 0.0000 | undef | 0.0000 |
| Pancreas | 0.0017 | 0.0166 | 0.0997 | 10.0285 |
| Penis | 0.0030 | 0.0000 | undef | 0.0000 |
| Prostate | 0.0000 | 0.0021 | 0.0000 | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0118 | | | |
| White blood cells | 0.0026 | | | |
| Cervix | 0.0106 | | | |

| | FETUS % frequency | STANDARDIZED/SUB-TRACTED LIBRARIES % frequency | |
|---|---|---|---|
| Development | 0.0139 | Breast | 0.0000 |
| Gastrointestinal | 0.0111 | Ovary_n | 0.0000 |
| Brain | 0.0063 | Ovary_t | 0.0000 |
| Hematopoietic | 0.0000 | Endocrine tissue | 0.0000 |
| Skin | 0.0000 | Fetal | 0.0041 |
| Hepatic | 0.0000 | Gastrointestinal | 0.0000 |
| Heart-blood vessels | 0.0036 | Hematopoietic | 0.0057 |
| Lung | 0.0108 | Skin-muscle | 0.0065 |
| Suprarenal gland | 0.0000 | Testicles | 0.0000 |
| Kidney | 0.0000 | Lung | 0.0000 |
| Placenta | 0.0061 | Nerves | 0.0050 |
| Prostate | 0.0249 | Prostate | 0.0000 |
| Sensory organs | 0.0000 | Sensory Organs | 0.0000 |
| | | Uterus_n | 0.0125 |

Electronic Northern for SEQ. ID NO.: 106

| | NORMAL % frequency | TUMOR % frequency | Ratios N/T | T/N |
|---|---|---|---|---|
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0007 | 0.0000 | undef | 0.0000 |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 107

| | NORMAL % frequency | TUMOR % frequency | Ratios N/T | T/N |
|---|---|---|---|---|
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0030 | 0.0000 | undef | 0.0000 |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0068 | 0.1055 | 0.0640 | 15.6211 |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 108

| | NORMAL % frequency | TUMOR % frequency | Ratios N/T | T/N |
|---|---|---|---|---|
| Bladder | 0.0000 | 0.0051 | 0.0000 | undef |
| Breast | 0.0051 | 0.0038 | 1.3611 | 0.7347 |
| Small intestine | 0.0031 | 0.0165 | 0.1854 | 5.3946 |
| Ovary | 0.0000 | 0.0026 | 0.0000 | undef |
| Endocrine tissue | 0.0034 | 0.0050 | 0.6792 | 1.4722 |
| Gastrointestinal | 0.0019 | 0.0000 | undef | 0.0000 |
| Brain | 0.0037 | 0.0062 | 0.6000 | 1.6668 |
| Hematopoietic | 0.0040 | 0.0000 | undef | 0.0000 |
| Skin | 0.0000 | 0.0000 | undef | undef |
| Hepatic | 0.0048 | 0.0000 | undef | 0.0000 |
| Heart | 0.0064 | 0.0000 | undef | 0.0000 |

-continued

| | | | | |
|---|---|---|---|---|
| Testicles | 0.0000 | 0.0000 | undef | undef |
| Lung | 0.0031 | 0.0041 | 0.7621 | 1.3122 |
| Stomach-esophagus | 0.0000 | 0.0000 | undef | undef |
| Muscle-skeleton | 0.0017 | 0.0000 | undef | 0.0000 |
| Kidney | 0.0000 | 0.0000 | undef | undef |
| Pancreas | 0.0000 | 0.0000 | undef | undef |
| Penis | 0.0030 | 0.0267 | 0.1123 | 8.9035 |
| Prostate | 0.0000 | 0.0000 | undef | undef |
| Uterus-endometrium | 0.0068 | 0.1055 | 0.0640 | 15.6211 |
| Uterus-myometrium | 0.0152 | 0.0068 | 2.2445 | 0.4455 |
| Uterus-general | 0.0000 | 0.0000 | undef | undef |
| Breast hyperplasia | 0.0000 | | | |
| Prostate hyperplasia | 0.0030 | | | |
| Seminal vesicle | 0.0000 | | | |
| Sensory organs | 0.0118 | | | |
| White blood cells | 0.0009 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0136 |
| Gastrointestinal | 0.0028 | Ovary_n | 0.0000 |
| Brain | 0.0000 | Ovary_t | 0.0000 |
| Hematopoietic | 0.0039 | Endocrine tissue | 0.0000 |
| Skin | 0.0000 | Fetal | 0.0035 |
| Hepatic | 0.0000 | Gastrointestinal | 0.0000 |
| Heart-blood vessels | 0.0000 | Hematopoietic | 0.0057 |
| Lung | 0.0036 | Skin-muscle | 0.0032 |
| Suprarenal gland | 0.0000 | Testicles | 0.0077 |
| Kidney | 0.0000 | Lung | 0.0164 |
| Placenta | 0.0000 | Nerves | 0.0030 |
| Prostate | 0.0249 | Prostate | 0.0000 |
| Sensory organs | 0.0126 | Sensory Organs | 0.0310 |
| | | Uterus_n | 0.0042 |

Electronic Northern for SEQ. ID NO.: 109

| | NORMAL % frequency | TUMOR % frequency | Ratios N/T | T/N |
|---|---|---|---|---|
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1583 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 110

| | NORMAL % frequency | TUMOR % frequency | Ratios N/T | T/N |
|---|---|---|---|---|
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1583 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0068 |
| Sensory organs | 0.0000 | Sensory Organs | 0.0000 |
| | | Uterus_n | 0.0000 |

Electronic Northern for SEQ. ID NO.: 111

| | NORMAL % frequency | TUMOR % frequency | Ratios N/T | T/N |
|---|---|---|---|---|
| Bladder | 0.0000 | 0.0000 | undef | undef |
| Breast | 0.0051 | 0.0000 | undef | 0.0000 |
| Small intestine | 0.0000 | 0.0000 | undef | undef |
| Ovary | 0.0000 | 0.0052 | 0.0000 | undef |
| Endocrine tissue | 0.0017 | 0.0000 | undef | 0.0000 |
| Gastrointestinal | 0.0000 | 0.0000 | undef | undef |
| Brain | 0.0022 | 0.0021 | 1.0799 | 0.9260 |

-continued

| | | | |
|---|---|---|---|
| Hematopoietic | 0.0027 | 0.0000 | undef | 0.0000 |
| Skin | 0.0037 | 0.0000 | undef | 0.0000 |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0010 | 0.0041 | 0.2540 | 3.9367 |
| Stomach-esophagus | 0.0000 | 0.0000 | undef | undef |
| Muscle-skeleton | 0.0034 | 0.0060 | 0.5711 | 1.7510 |
| Kidney | 0.0000 | 0.0000 | undef | undef |
| Pancreas | 0.0017 | 0.0000 | undef | 0.0000 |
| Penis | 0.0000 | 0.0000 | undef | undef |
| Prostate | 0.0022 | 0.0000 | undef | 0.0000 |
| Uterus-endometrium | 0.0000 | 0.1583 | 0.0000 | undef |
| Uterus-myometrium | 0.0076 | 0.0000 | undef | 0.0000 |
| Uterus-general | 0.0000 | 0.0000 | undef | undef |
| Breast hyperplasia | 0.0032 | | | |
| Prostate hyperplasia | 0.0089 | | | |
| Seminal vesicle | 0.0089 | | | |
| Sensory organs | 0.0000 | | | |
| White blood cells | 0.0000 | | | |
| Cervix | 0.0106 | | | |

| | FETUS<br>% frequency | STANDARDIZED/SUB-<br>TRACTED LIBRARIES<br>% frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0051 |
| Hematopoietic | 0.0039 | Endocrine tissue | 0.0000 |
| Skin | 0.0000 | Fetal | 0.0070 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0231 |
| Kidney | 0.0000 | Lung | 0.0164 |
| Placenta | 0.0000 | Nerves | 0.0050 |
| Prostate | 0.0000 | Prostate | 0.0000 |
| Sensory organs | 0.0000 | Sensory Organs | 0.0000 |
| | | Uterus_n | 0.0125 |

Electronic Northern for SEQ. ID NO.: 112

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0017 | 0.0000 | undef | 0.0000 |
| Gastrointestinal | 0.0019 | 0.0000 | undef | 0.0000 |
| Brain | 0.0022 | 0.0010 | 2.1599 | 0.4630 |
| Hematopoietic | 0.0027 | 0.0000 | undef | 0.0000 |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0097 | 0.0000 | undef | 0.0000 |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1055 | 0.0000 | undef |
| Uterus-myometrium | 0.0076 | 0.0000 | undef | 0.0000 |
| Uterus-general | 0.0051 | 0.0000 | undef | 0.0000 |
| Breast hyperplasia | 0.0032 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS<br>% frequency | STANDARDIZED/SUB-<br>TRACTED LIBRARIES<br>% frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0039 | Endocrine tissue | 0.0000 |
| Skin | 0.0000 | Fetal | 0.0012 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0125 |

Electronic Northern for SEQ. ID NO.: 113

| | NORMAL | TUMOR | Ratios | |
|---|---|---|---|---|
| | % frequency | % frequency | N/T | T/N |
| Bladder | 0.0000 | 0.0077 | 0.0000 | undef |
| Breast | 0.0038 | 0.0038 | 1.0208 | 0.9796 |
| Small intestine | 0.0031 | 0.0165 | 0.1854 | 5.3946 |
| Ovary | 0.0000 | 0.0026 | 0.0000 | undef |
| Endocrine tissue | 0.0051 | 0.0050 | 0.0189 | 0.9815 |
| Gastrointestinal | 0.0019 | 0.0000 | undef | 0.0000 |
| Brain | 0.0037 | 0.0062 | 0.6000 | 1.6668 |
| Hematopoietic | 0.0067 | 0.0000 | undef | 0.0000 |
| Skin | 0.0000 | 0.0000 | undef | undef |
| Hepatic | 0.0048 | 0.0000 | undef | 0.0000 |
| Heart | 0.0064 | 0.0000 | undef | 0.0000 |
| Testicles | 0.0000 | 0.0000 | undef | undef |
| Lung | 0.0031 | 0.0041 | 0.7621 | 1.3122 |
| Stomach-esophagus | 0.0000 | 0.0000 | undef | undef |
| Muscle-skeleton | 0.0017 | 0.0000 | undef | 0.0000 |
| Kidney | 0.0000 | 0.0000 | undef | undef |
| Pancreas | 0.0000 | 0.0000 | undef | undef |
| Penis | 0.0060 | 0.0267 | 0.2246 | 4.4517 |
| Prostate | 0.0000 | 0.0021 | 0.0000 | undef |
| Uterus-endometrium | 0.0068 | 0.1055 | 0.0640 | 15.6211 |
| Uterus-myometrium | 0.0152 | 0.0068 | 2.2445 | 0.4455 |
| Uterus-general | 0.0000 | 0.0000 | undef | undef |
| Breast hyperplasia | 0.0000 | | | |
| Prostate hyperplasia | 0.0030 | | | |
| Seminal vesicle | 0.0000 | | | |
| Sensory organs | 0.0118 | | | |
| White blood cells | 0.0017 | | | |
| Cervix | 0.0000 | | | |

| | FETUS<br>% frequency | STANDARDIZED/SUB-<br>TRACTED LIBRARIES<br>% frequency | |
|---|---|---|---|
| Development | 0.0000 | Breast | 0.0136 |
| Gastrointestinal | 0.0028 | Ovary_n | 0.0000 |
| Brain | 0.0000 | Ovary_t | 0.0000 |
| Hematopoietic | 0.0039 | Endocrine tissue | 0.0000 |
| Skin | 0.0000 | Fetal | 0.0052 |
| Hepatic | 0.0000 | Gastrointestinal | 0.0000 |
| Heart-blood vessels | 0.0036 | Hematopoietic | 0.0057 |
| Lung | 0.0036 | Skin-muscle | 0.0032 |
| Suprarenal gland | 0.0000 | Testicles | 0.0077 |
| Kidney | 0.0000 | Lung | 0.0164 |
| Placenta | 0.0000 | Nerves | 0.0030 |
| Prostate | 0.0249 | Prostate | 0.0000 |
| Sensory organs | 0.0126 | Sensory Organs | 0.0310 |
| | | Uterus_n | 0.0042 |

-continued

Electronic Northern for SEQ. ID NO.: 114

|  | NORMAL | TUMOR | Ratios | |
|---|---|---|---|---|
|  | % frequency | % frequency | N/T | T/N |
| Bladder | 0.0156 | 0.0000 | undef | 0.0000 |
| Breast | 0.0013 | 0.0019 | 0.6815 | 1.4694 |
| Small intestine | 0.0000 | 0.0000 | undef | undef |
| Ovary | 0.0060 | 0.0078 | 0.7675 | 1.3029 |
| Endocrine tissue | 0.0000 | 0.0025 | 0.0000 | undef |
| Gastrointestinal | 0.0038 | 0.0093 | 0.4142 | 2.4145 |
| Brain | 0.0022 | 0.0021 | 1.0799 | 0.9260 |
| Hematopoietic | 0.0027 | 0.0000 | undef | 0.0000 |
| Skin | 0.0110 | 0.0000 | undef | 0.0000 |
| Hepatic | 0.0000 | 0.0000 | undef | undef |
| Heart | 0.0095 | 0.0412 | 0.2313 | 4.3235 |
| Testicles | 0.0000 | 0.0000 | undef | undef |
| Lung | 0.0031 | 0.0164 | 0.1905 | 5.2490 |
| Stomach-esophagus | 0.0193 | 0.0000 | undef | 0.0000 |
| Muscle-skeleton | 0.0069 | 0.0180 | 0.3807 | 2.6265 |
| Kidney | 0.0027 | 0.0000 | undef | 0.0000 |
| Pancreas | 0.0000 | 0.0000 | undef | undef |
| Penis | 0.0030 | 0.0000 | undef | 0.0000 |
| Prostate | 0.0022 | 0.0064 | 0.3412 | 2.9308 |
| Uterus-endometrium | 0.0068 | 0.2111 | 0.0320 | 31.2422 |
| Uterus-myometrium | 0.0000 | 0.0204 | 0.0000 | undef |
| Uterus-general | 0.0102 | 0.0000 | undef | 0.0000 |
| Breast hyperplasia | 0.0032 | | | |
| Prostate hyperplasia | 0.0089 | | | |
| Seminal vesicle | 0.0000 | | | |
| Sensory organs | 0.0000 | | | |
| White blood cells | 0.0017 | | | |
| Cervix | 0.0106 | | | |

|  | FETUS % frequency | STANDARDIZED/SUB-TRACTED LIBRARIES % frequency |  |
|---|---|---|---|
| Development | 0.0139 | Breast | 0.0000 |
| Gastrointestinal | 0.0000 | Ovary_n | 0.1595 |
| Brain | 0.0000 | Ovary_t | 0.0000 |
| Hematopoietic | 0.0039 | Endocrine tissue | 0.0000 |
| Skin | 0.0000 | Fetal | 0.0087 |
| Hepatic | 0.0260 | Gastrointestinal | 0.0244 |
| Heart-blood vessels | 0.0107 | Hematopoietic | 0.0057 |
| Lung | 0.0000 | Skin-muscle | 0.0356 |
| Suprarenal gland | 0.0254 | Testicles | 0.0000 |
| Kidney | 0.0062 | Lung | 0.0164 |
| Placenta | 0.0061 | Nerves | 0.0010 |
| Prostate | 0.0000 | Prostate | 0.0000 |
| Sensory organs | 0.0000 | Sensory Organs | 0.0000 |
|  |  | Uterus_n | 0.0250 |

Electronic Northern for SEQ. ID NO.: 115

|  | NORMAL | TUMOR | Ratios | |
|---|---|---|---|---|
|  | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0058 | 0.0000 | undef | 0.0000 |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

|  | FETUS % frequency | STANDARDIZED/SUB-TRACTED LIBRARIES % frequency |  |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0017 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
|  |  | Uterus_n | 0.0000 |

Electronic Northern for SEQ. ID NO.: 116

|  | NORMAL | TUMOR | Ratios | |
|---|---|---|---|---|
|  | % frequency | % frequency | N/T | T/N |
| Bladder | 0.0039 | 0.0077 | 0.5085 | 1.9666 |
| Breast | 0.0128 | 0.0000 | undef | 0.0000 |
| Small intestine | 0.0061 | 0.0165 | 0.3707 | 2.6973 |
| Ovary | 0.0060 | 0.0000 | undef | 0.0000 |
| Endocrine tissue | 0.0068 | 0.0050 | 1.3585 | 0.7361 |
| Gastrointestinal | 0.0038 | 0.0046 | 0.8283 | 1.2072 |
| Brain | 0.0037 | 0.0051 | 0.7200 | 1.3890 |
| Hematopoietic | 0.0027 | 0.0000 | undef | 0.0000 |
| Skin | 0.0147 | 0.0000 | undef | 0.0000 |
| Hepatic | 0.0000 | 0.0000 | undef | undef |
| Heart | 0.0042 | 0.0137 | 0.3084 | 3.2426 |
| Testicles | 0.0058 | 0.0000 | undef | 0.0000 |
| Lung | 0.0042 | 0.0041 | 1.0161 | 0.9842 |
| Stomach-esophagus | 0.0000 | 0.0000 | undef | undef |
| Muscle-skeleton | 0.0086 | 0.0000 | undef | 0.0000 |
| Kidney | 0.0054 | 0.0068 | 0.7930 | 1.2610 |
| Pancreas | 0.0033 | 0.0000 | undef | 0.0000 |
| Penis | 0.0090 | 0.0000 | undef | 0.0000 |
| Prostate | 0.0022 | 0.0043 | 0.5118 | 1.9538 |
| Uterus-endometrium | 0.0068 | 0.1055 | 0.0640 | 15.6211 |
| Uterus-myometrium | 0.0076 | 0.0000 | undef | 0.0000 |
| Uterus-general | 0.0051 | 0.0000 | undef | 0.0000 |
| Breast hyperplasia | 0.0128 | | | |
| Prostate hyperplasia | 0.0089 | | | |
| Seminal vesicle | 0.0000 | | | |
| Sensory organs | 0.0118 | | | |
| White blood cells | 0.0061 | | | |
| Cervix | 0.0106 | | | |

|  | FETUS % frequency | STANDARDIZED/SUB-TRACTED LIBRARIES % frequency |  |
|---|---|---|---|
| Development | 0.0139 | Breast | 0.0000 |
| Gastrointestinal | 0.0056 | Ovary_n | 0.0000 |
| Brain | 0.0000 | Ovary_t | 0.0051 |
| Hematopoietic | 0.0039 | Endocrine tissue | 0.0245 |
| Skin | 0.0000 | Fetal | 0.0076 |
| Hepatic | 0.0000 | Gastrointestinal | 0.0000 |
| Heart-blood vessels | 0.0000 | Hematopoietic | 0.0228 |
| Lung | 0.0036 | Skin-muscle | 0.0227 |
| Suprarenal gland | 0.0000 | Testicles | 0.0000 |
| Kidney | 0.0000 | Lung | 0.0000 |
| Placenta | 0.0061 | Nerves | 0.0060 |

-continued

| | | | |
|---|---|---|---|
| Prostate | 0.0000 | Prostate | 0.0068 |
| Sensory organs | 0.0000 | Sensory Organs | 0.0155 |
| | | Uterus_n | 0.0083 |

Electronic Northern for SEQ. ID NO.: 117

| | NORMAL | TUMOR | Ratios | |
|---|---|---|---|---|
| | % frequency | % frequency | N/T | T/N |
| Bladder | 0.0039 | 0.0026 | 1.5254 | 0.6555 |
| Breast | 0.0038 | 0.0094 | 0.4083 | 2.4491 |
| Small intestine | 0.0061 | 0.0000 | undef | 0.0000 |
| Ovary | 0.0030 | 0.0052 | 0.5756 | 1.7372 |
| Endocrine tissue | 0.0000 | 0.0050 | 0.0000 | undef |
| Gastrointestinal | 0.0019 | 0.0046 | 0.4142 | 2.4145 |
| Brain | 0.0037 | 0.0000 | undef | 0.0000 |
| Hematopoietic | 0.0040 | 0.0000 | undef | 0.0000 |
| Skin | 0.0037 | 0.0000 | undef | 0.0000 |
| Hepatic | 0.0048 | 0.0000 | undef | 0.0000 |
| Heart | 0.0021 | 0.0137 | 0.1542 | 6.4853 |
| Testicles | 0.0000 | 0.0000 | undef | undef |
| Lung | 0.0000 | 0.0041 | 0.0000 | undef |
| Stomach-esophagus | 0.0000 | 0.0000 | undef | undef |
| Muscle-skeleton | 0.0000 | 0.0000 | undef | undef |
| Kidney | 0.0027 | 0.0000 | undef | 0.0000 |
| Pancreas | 0.0000 | 0.0000 | undef | undef |
| Penis | 0.0030 | 0.0000 | undef | 0.0000 |
| Prostate | 0.0044 | 0.0128 | 0.3412 | 2.9308 |
| Uterus-endometrium | 0.0068 | 0.1055 | 0.0640 | 15.6211 |
| Uterus-myometrium | 0.0000 | 0.0000 | undef | undef |
| Uterus-general | 0.0000 | 0.0000 | undef | undef |
| Breast hyperplasia | 0.0096 | | | |
| Prostate hyperplasia | 0.0030 | | | |
| Seminal vesicle | 0.0000 | | | |
| Sensory organs | 0.0000 | | | |
| White blood cells | 0.0087 | | | |
| Cervix | 0.0000 | | | |

| | FETUS % frequency | STANDARDIZED/SUB-TRACTED LIBRARIES % frequency | | |
|---|---|---|---|---|
| Development | 0.0000 | Breast | | 0.0000 |
| Gastrointestinal | 0.0000 | Ovary_n | | 0.0000 |
| Brain | 0.0000 | Ovary_t | | 0.0101 |
| Hematopoietic | 0.0000 | Endocrine tissue | | 0.0000 |
| Skin | 0.0000 | Fetal | | 0.0041 |
| Hepatic | 0.0000 | Gastrointestinal | | 0.0000 |
| Heart-blood vessels | 0.0000 | Hematopoietic | | 0.0456 |
| Lung | 0.0000 | Skin-muscle | | 0.0000 |
| Suprarenal gland | 0.0000 | Testicles | | 0.0154 |
| Kidney | 0.0000 | Lung | | 0.0000 |
| Placenta | 0.0000 | Nerves | | 0.0010 |
| Prostate | 0.0000 | Prostate | | 0.0068 |
| Sensory organs | 0.0000 | Sensory Organs | | 0.0000 |
| | | Uterus_n | | 0.0042 |

Electronic Northern for SEQ. ID NO.: 118

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0026 | 0.0000 | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | | |
|---|---|---|---|---|
| Development | 0.0000 | Breast | | 0.0000 |
| Gastrointestinal | 0.0000 | Ovary_n | | 0.0000 |
| Brain | 0.0000 | Ovary_t | | 0.0000 |
| Hematopoietic | 0.0000 | Endocrine tissue | | 0.0000 |
| Skin | 0.0000 | Fetal | | 0.0000 |
| Hepatic | 0.0000 | Gastrointestinal | | 0.0000 |
| Heart-blood vessels | 0.0000 | Hematopoietic | | 0.0000 |
| Lung | 0.0000 | Skin-muscle | | 0.0000 |
| Suprarenal gland | 0.0000 | Testicles | | 0.0077 |
| Kidney | 0.0000 | Lung | | 0.0000 |
| Placenta | 0.0000 | Nerves | | 0.0000 |
| Prostate | 0.0000 | Prostate | | 0.0000 |
| Sensory organs | 0.0000 | Sensory Organs | | 0.0000 |
| | | Uterus_n | | 0.0000 |

Electronic Northern for SEQ. ID NO.: 119

| | NORMAL | TUMOR | Ratios | |
|---|---|---|---|---|
| | % frequency | % frequency | N/T | T/N |
| Bladder | 0.0039 | 0.0000 | undef | 0.0000 |
| Breast | 0.0013 | 0.0038 | 0.3403 | 2.9389 |
| Small intestine | 0.0000 | 0.0000 | undef | undef |
| Ovary | 0.0000 | 0.0052 | 0.0000 | undef |
| Endocrine tissue | 0.0034 | 0.0050 | 0.6792 | 1.4722 |
| Gastrointestinal | 0.0019 | 0.0000 | undef | 0.0000 |
| Brain | 0.0007 | 0.0041 | 0.1800 | 5.5559 |
| Hematopoietic | 0.0040 | 0.0000 | undef | 0.0000 |
| Skin | 0.0037 | 0.0000 | undef | 0.0000 |
| Hepatic | 0.0000 | 0.0000 | undef | undef |
| Heart | 0.0011 | 0.0000 | undef | 0.0000 |
| Testicles | 0.0000 | 0.0000 | undef | undef |
| Lung | 0.0010 | 0.0000 | undef | 0.0000 |
| Stomach-esophagus | 0.0000 | 0.0153 | 0.0000 | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0022 | 0.0021 | 1.0236 | 0.9769 |
| Uterus-endometrium | 0.0068 | 0.1055 | 0.0640 | 15.6211 |
| Uterus-myometrium | 0.0000 | 0.0000 | undef | undef |
| Uterus-general | 0.0102 | 0.0000 | undef | 0.0000 |
| Breast hyperplasia | 0.0000 | | | |
| Prostate hyperplasia | 0.0030 | | | |
| Seminal vesicle | 0.0000 | | | |
| Sensory organs | 0.0000 | | | |
| White blood cells | 0.0026 | | | |
| Cervix | 0.0000 | | | |

| | FETUS % frequency | STANDARDIZED/SUB-TRACTED LIBRARIES % frequency | | |
|---|---|---|---|---|
| Development | 0.0000 | Breast | | 0.0000 |
| Gastrointestinal | 0.0028 | Ovary_n | | 0.0000 |
| Brain | 0.0000 | Ovary_t | | 0.0000 |
| Hematopoietic | 0.0000 | Endocrine tissue | | 0.0000 |
| Skin | 0.0000 | Fetal | | 0.0023 |
| Hepatic | 0.0000 | Gastrointestinal | | 0.0000 |
| Heart-blood vessels | 0.0000 | Hematopoietic | | 0.0000 |

-continued

| | | | | |
|---|---|---|---|---|
| Lung | 0.0000 | Skin-muscle | | 0.0032 |
| Suprarenal gland | 0.0000 | Testicles | | 0.0000 |
| Kidney | 0.0000 | Lung | | 0.0000 |
| Placenta | 0.0061 | Nerves | | 0.0110 |
| Prostate | 0.0000 | Prostate | | 0.0000 |
| Sensory organs | 0.0126 | Sensory Organs | | 0.0155 |
| | | Uterus_n | | 0.0000 |

Electronic Northern for SEQ. ID NO.: 120

| | NORMAL | TUMOR | Ratios | |
|---|---|---|---|---|
| | % frequency | % frequency | N/T | T/N |
| Bladder | 0.0195 | 0.0077 | 2.5424 | 0.3933 |
| Breast | 0.0090 | 0.0075 | 1.1909 | 0.8397 |
| Small intestine | 0.0031 | 0.0000 | undef | 0.0000 |
| Ovary | 0.0060 | 0.0078 | 0.7675 | 1.3029 |
| Endocrine tissue | 0.0068 | 0.0125 | 0.5434 | 1.8403 |
| Gastrointestinal | 0.0038 | 0.0093 | 0.4142 | 2.4145 |
| Brain | 0.0059 | 0.0031 | 1.9199 | 0.5209 |
| Hematopoietic | 0.0027 | 0.0758 | 0.0353 | 28.3379 |
| Skin | 0.0037 | 0.0000 | undef | 0.0000 |
| Hepatic | 0.0000 | 0.0065 | 0.0000 | undef |
| Heart | 0.0042 | 0.0000 | undef | 0.0000 |
| Testicles | 0.0000 | 0.0000 | undef | undef |
| Lung | 0.0042 | 0.0041 | 1.0161 | 0.9842 |
| Stomach-esophagus | 0.0000 | 0.0000 | undef | undef |
| Muscle-skeleton | 0.0034 | 0.0060 | 0.5711 | 1.7510 |
| Kidney | 0.0109 | 0.0137 | 0.7930 | 1.2610 |
| Pancreas | 0.0033 | 0.0000 | undef | 0.0000 |
| Penis | 0.0150 | 0.0000 | undef | 0.0000 |
| Prostate | 0.0087 | 0.0000 | undef | 0.0000 |
| Uterus-endometrium | 0.0000 | 0.1055 | 0.0000 | undef |
| Uterus-myometrium | 0.0000 | 0.0000 | undef | undef |
| Uterus-general | 0.0051 | 0.0000 | undef | 0.0000 |
| Breast hyperplasia | 0.0000 | | | |
| Prostate hyperplasia | 0.0000 | | | |
| Seminal vesicle | 0.0000 | | | |
| Sensory organs | 0.0118 | | | |
| White blood cells | 0.0043 | | | |
| Cervix | 0.0000 | | | |

| | FETUS % frequency | STANDARDIZED/SUB-TRACTED LIBRARIES % frequency | |
|---|---|---|---|
| Development | 0.0139 | Breast | 0.0000 |
| Gastrointestinal | 0.0028 | Ovary_n | 0.0000 |
| Brain | 0.0000 | Ovary_t | 0.0051 |
| Hematopoietic | 0.0000 | Endocrine tissue | 0.0000 |
| Skin | 0.0000 | Fetal | 0.0012 |
| Hepatic | 0.0000 | Gastrointestinal | 0.0000 |
| Heart-blood vessels | 0.0071 | Hematopoietic | 0.0228 |
| Lung | 0.0145 | Skin-muscle | 0.0000 |
| Suprarenal gland | 0.0000 | Testicles | 0.0154 |
| Kidney | 0.0000 | Lung | 0.0000 |
| Placenta | 0.0000 | Nerves | 0.0060 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 121

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0010 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 122

| | NORMAL | TUMOR | Ratios | |
|---|---|---|---|---|
| | % frequency | % frequency | N/T | T/N |
| Bladder | 0.0234 | 0.0230 | 1.0170 | 0.9833 |
| Breast | 0.0269 | 0.0207 | 1.2992 | 0.7697 |
| Small intestine | 0.0061 | 0.0662 | 0.0927 | 10.7893 |
| Ovary | 0.0150 | 0.0572 | 0.2616 | 3.8219 |
| Endocrine tissue | 0.0085 | 0.0100 | 0.8491 | 1.1778 |
| Gastrointestinal | 0.0134 | 0.0463 | 0.2899 | 3.4492 |
| Brain | 0.0015 | 0.0092 | 0.1600 | 6.2504 |
| Hematopoietic | 0.0094 | 0.0000 | undef | 0.0000 |
| Skin | 0.0551 | 0.0000 | undef | 0.0000 |
| Hepatic | 0.0143 | 0.0388 | 0.3676 | 2.7200 |
| Heart | 0.0085 | 0.0000 | undef | 0.0000 |
| Testicles | 0.0058 | 0.0117 | 0.4920 | 2.0326 |
| Lung | 0.0073 | 0.0286 | 0.2540 | 3.9367 |
| Stomach-esophagus | 0.0966 | 0.0077 | 12.6053 | 0.0793 |
| Muscle-skeleton | 0.0000 | 0.0060 | 0.0000 | undef |
| Kidney | 0.0054 | 0.0068 | 0.7930 | 1.2610 |
| Pancreas | 0.0050 | 0.0055 | 0.8974 | 1.1143 |
| Penis | 0.0329 | 0.1600 | 0.2059 | 4.8565 |
| Prostate | 0.0087 | 0.0043 | 2.0473 | 0.4885 |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0128 | | | |
| Prostate hyperplasia | 0.0148 | | | |
| Seminal vesicle | 0.0178 | | | |
| Sensory organs | 0.0000 | | | |
| White blood cells | 0.0017 | | | |
| Cervix | 0.0532 | | | |

| | FETUS % frequency | STANDARDIZED/SUB-TRACTED LIBRARIES % frequency | |
|---|---|---|---|
| Development | 0.0417 | Breast | 0.0136 |
| Gastrointestinal | 0.0056 | Ovary_n | 0.0000 |
| Brain | 0.0000 | Ovary_t | 0.0101 |

-continued

| | | | | |
|---|---|---|---|---|
| Hematopoietic | 0.0000 | Endocrine tissue | 0.0000 | |
| Skin | 0.0000 | Fetal | 0.0146 | |
| Hepatic | 0.0000 | Gastrointestinal | 0.0366 | |
| Heart-blood vessels | 0.0071 | Hematopoietic | 0.0000 | |
| Lung | 0.0036 | Skin-muscle | 0.0032 | |
| Suprarenal gland | 0.0000 | Testicles | 0.0000 | |
| Kidney | 0.0062 | Lung | 0.0573 | |
| Placenta | 0.0121 | Nerves | 0.0040 | |
| Prostate | 0.0249 | Prostate | 0.0205 | |
| Sensory organs | 0.0000 | Sensory Organs | 0.0077 | |
| | | Uterus_n | 0.0000 | |

Electronic Northern for SEQ. ID NO.: 123

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0019 | 0.0046 | 0.4142 | 2.4145 |
| Brain | 0.0007 | 0.0031 | 0.2400 | 4.1669 |
| Hematopoietic | 0.0027 | 0.0000 | undef | 0.0000 |
| Skin | 0.0073 | 0.0000 | undef | 0.0000 |
| Hepatic | 0.0000 | 0.0065 | 0.0000 | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1583 | 0.0000 | undef |
| Uterus-myometrium | 0.0000 | 0.0000 | undef | undef |
| Uterus-general | 0.0051 | 0.0000 | undef | 0.0000 |
| Breast hyperplasia | 0.0000 | | | |
| Prostate hyperplasia | 0.0030 | | | |
| Seminal vesicle | 0.0089 | | | |
| Sensory organs | 0.0000 | | | |
| White blood cells | 0.0000 | | | |
| Cervix | 0.0000 | | | |

| | FETUS | STANDARDIZED/SUB- TRACTED LIBRARIES | | |
|---|---|---|---|---|
| | % frequency | % frequency | | |
| Development | 0.0000 | Breast | 0.0000 | |
| Gastrointestinal | 0.0000 | Ovary_n | 0.0000 | |
| Brain | 0.0000 | Ovary_t | 0.0000 | |
| Hematopoietic | 0.0000 | Endocrine tissue | 0.0000 | |
| Skin | 0.0000 | Fetal | 0.0000 | |
| Hepatic | 0.0000 | Gastrointestinal | 0.0000 | |
| Heart-blood vessels | 0.0000 | Hematopoietic | 0.0000 | |
| Lung | 0.0036 | Skin-muscle | 0.0000 | |
| Suprarenal gland | 0.0000 | Testicles | 0.0000 | |
| Kidney | 0.0000 | Lung | 0.0000 | |
| Placenta | 0.0000 | Nerves | 0.0000 | |
| Prostate | 0.0000 | Prostate | 0.0000 | |
| Sensory organs | 0.0000 | Sensory Organs | 0.0000 | |
| | | Uterus_n | 0.0000 | |

Electronic Northern for SEQ. ID NO.: 124

| | NORMAL | TUMOR | Ratios | |
|---|---|---|---|---|
| | % frequency | % frequency | N/T | T/N |
| Bladder | 0.0000 | 0.0051 | 0.0000 | undef |
| Breast | 0.0000 | 0.0000 | undef | undef |
| Small intestine | 0.0000 | 0.0165 | 0.0000 | undef |
| Ovary | 0.0000 | 0.0026 | 0.0000 | undef |
| Endocrine tissue | 0.0051 | 0.0000 | undef | 0.0000 |
| Gastrointestinal | 0.0096 | 0.0000 | undef | 0.0000 |
| Brain | 0.0037 | 0.0010 | 3.5998 | 0.2778 |
| Hematopoietic | 0.0000 | 0.0000 | undef | undef |
| Skin | 0.0073 | 0.0000 | undef | 0.0000 |
| Hepatic | 0.0095 | 0.0065 | 1.4706 | 0.6800 |
| Heart | 0.0000 | 0.0000 | undef | 0.0000 |
| Testicles | 0.0095 | 0.0000 | undef | undef |
| Lung | 0.0021 | 0.0020 | 1.0161 | 0.9842 |
| Stomach-esophagus | 0.0000 | 0.0000 | undef | undef |
| Muscle-skeleton | 0.0017 | 0.0060 | 0.2856 | 3.5020 |
| Kidney | 0.0027 | 0.0068 | 0.3965 | 2.5219 |
| Pancreas | 0.0017 | 0.0110 | 0.1496 | 6.6857 |
| Penis | 0.0000 | 0.0000 | undef | undef |
| Prostate | 0.0065 | 0.0000 | undef | 0.0000 |
| Uterus-endometrium | 0.0068 | 0.1055 | 0.0640 | 15.6211 |
| Uterus-myometrium | 0.0000 | 0.0000 | undef | undef |
| Uterus-general | 0.0051 | 0.0000 | undef | 0.0000 |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS | STANDARDIZED/SUB- TRACTED LIBRARIES | | |
|---|---|---|---|---|
| | % frequency | % frequency | | |
| Development | 0.0000 | Breast | 0.0000 | |
| Gastrointestinal | 0.0028 | Ovary_n | 0.0000 | |
| Brain | 0.0063 | Ovary_t | 0.0000 | |
| Hematopoietic | 0.0000 | Endocrine tissue | 0.0245 | |
| Skin | 0.0000 | Fetal | 0.0082 | |
| Hepatic | 0.0000 | Gastrointestinal | 0.0122 | |
| Heart-blood vessels | 0.0036 | Hematopoietic | 0.0000 | |
| Lung | 0.0036 | Skin-muscle | 0.0032 | |
| Suprarenal gland | 0.0000 | Testicles | 0.0000 | |
| Kidney | 0.0062 | Lung | 0.0246 | |
| Placenta | 0.0000 | Nerves | 0.0100 | |
| Prostate | 0.0000 | Prostate | 0.0000 | |
| Sensory organs | 0.0126 | Sensory Organs | 0.0077 | |
| | | Uterus_n | 0.0042 | |

Electronic Northern for SEQ. ID NO.: 125

| | NORMAL | TUMOR | Ratios | |
|---|---|---|---|---|
| | % frequency | % frequency | N/T | T/N |
| Bladder | 0.0195 | 0.0077 | 2.5424 | 0.3933 |
| Breast | 0.0064 | 0.0075 | 0.8507 | 1.1756 |
| Small intestine | 0.0061 | 0.0000 | undef | 0.0000 |
| Ovary | 0.0000 | 0.0130 | 0.0000 | undef |
| Endocrine tissue | 0.0153 | 0.0226 | 0.6792 | 1.4722 |
| Gastrointestinal | 0.0077 | 0.0093 | 0.8283 | 1.2072 |
| Brain | 0.0081 | 0.0092 | 0.8800 | 1.1364 |
| Hematopoietic | 0.0067 | 0.0379 | 0.1764 | 5.6676 |
| Skin | 0.0110 | 0.0000 | undef | 0.0000 |
| Hepatic | 0.0048 | 0.0194 | 0.2451 | 4.0800 |
| Heart | 0.0106 | 0.0000 | undef | 0.0000 |
| Testicles | 0.0000 | 0.0000 | undef | undef |
| Lung | 0.0083 | 0.0102 | 0.8129 | 1.2302 |
| Stomach-esophagus | 0.0000 | 0.0153 | 0.0000 | undef |
| Muscle-skeleton | 0.0103 | 0.0180 | 0.5711 | 1.7510 |
| Kidney | 0.0081 | 0.0068 | 1.1896 | 0.8406 |
| Pancreas | 0.0033 | 0.0000 | undef | 0.0000 |
| Penis | 0.0329 | 0.0000 | undef | 0.0000 |
| Prostate | 0.0153 | 0.0064 | 2.3885 | 0.4187 |
| Uterus-endometrium | 0.0135 | 0.1055 | 0.1280 | 7.8106 |
| Uterus-myometrium | 0.0305 | 0.0136 | 2.2445 | 0.4455 |
| Uterus-general | 0.0051 | 0.0000 | undef | 0.0000 |
| Breast hyperplasia | 0.0064 | | | |
| Prostate hyperplasia | 0.0059 | | | |
| Seminal vesicle | 0.0000 | | | |
| Sensory organs | 0.0118 | | | |
| White blood cells | 0.0069 | | | |
| Cervix | 0.0106 | | | |

-continued

|  | FETUS % frequency | STANDARDIZED/SUB- TRACTED LIBRARIES % frequency |  |
|---|---|---|---|
| Development | 0.0139 | Breast | 0.0136 |
| Gastrointestinal | 0.0056 | Ovary_n | 0.0000 |
| Brain | 0.0000 | Ovary_t | 0.0203 |
| Hematopoietic | 0.0157 | Endocrine tissue | 0.0245 |
| Skin | 0.0000 | Fetal | 0.0099 |
| Hepatic | 0.0000 | Gastrointestinal | 0.0122 |
| Heart-blood vessels | 0.0036 | Hematopoietic | 0.0171 |
| Lung | 0.0000 | Skin-muscle | 0.0097 |
| Suprarenal gland | 0.0000 | Testicles | 0.0000 |
| Kidney | 0.0000 | Lung | 0.0246 |
| Placenta | 0.0121 | Nerves | 0.0060 |
| Prostate | 0.0249 | Prostate | 0.0342 |
| Sensory organs | 0.0000 | Sensory Organs | 0.0387 |
|  |  | Uterus_n | 0.0250 |

Electronic Northern for SEQ. ID NO.: 126

|  | NORMAL % frequency | TUMOR % frequency | Ratios N/T | T/N |
|---|---|---|---|---|
| Bladder | 0.0039 | 0.0000 | undef | 0.0000 |
| Breast | 0.0013 | 0.0019 | 0.6805 | 1.4694 |
| Small intestine | 0.0000 | 0.0000 | undef | undef |
| Ovary | 0.0000 | 0.0000 | undef | undef |
| Endocrine tissue | 0.0000 | 0.0025 | 0.0000 | undef |
| Gastrointestinal | 0.0000 | 0.0000 | undef | undef |
| Brain | 0.0000 | 0.0010 | 0.0000 | undef |
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0021 | 0.0000 | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 |  |  |  |
| Prostate hyperplasia | 0.0000 |  |  |  |
| Seminal vesicle | 0.0000 |  |  |  |
| Sensory organs | 0.0000 |  |  |  |
| White blood cells | 0.0000 |  |  |  |
| Cervix | 0.0000 |  |  |  |

|  | FETUS % frequency | STANDARDIZED/SUB- TRACTED LIBRARIES % frequency |  |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0006 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0032 |
| Suprarenal gland | 0.0000 | Testicles | 0.0000 |
| Kidney | 0.0000 | Lung | 0.0000 |
| Placenta | 0.0000 | Nerves | 0.0010 |
| Prostate | 0.0000 | Prostate | 0.0000 |
| Sensory organs | 0.0000 | Sensory Organs | 0.0000 |
|  |  | Uterus_n | 0.0000 |

Electronic Northern for SEQ. ID NO.: 127

|  | NORMAL % frequency | TUMOR % frequency | Ratios N/T | T/N |
|---|---|---|---|---|
| Bladder | 0.0312 | 0.0486 | 0.6423 | 1.5569 |
| Breast | 0.0192 | 0.0282 | 0.6805 | 1.4694 |
| Small intestine | 0.0399 | 0.0000 | undef | 0.0000 |
| Ovary | 0.0210 | 0.0364 | 0.5756 | 1.7372 |
| Endocrine tissue | 0.0290 | 0.0326 | 0.8882 | 1.1258 |
| Gastrointestinal | 0.0460 | 0.0231 | 1.9880 | 0.5030 |
| Brain | 0.0532 | 0.0575 | 0.9257 | 1.0803 |
| Hematopoietic | 0.0348 | 0.0379 | 0.9175 | 1.0899 |
| Skin | 0.0367 | 0.0000 | undef | 0.0000 |
| Hepatic | 0.0048 | 0.0647 | 0.0735 | 13.5999 |
| Heart | 0.0699 | 0.0412 | 1.6961 | 0.5896 |
| Testicles | 0.0288 | 0.4210 | 0.0683 | 14.6349 |
| Lung | 0.0343 | 0.0368 | 0.9314 | 1.0737 |
| Stomach-esophagus | 0.0773 | 0.0230 | 3.3614 | 0.2975 |
| Muscle-skeleton | 0.0497 | 0.0660 | 0.7528 | 1.3283 |
| Kidney | 0.0353 | 0.1575 | 0.2241 | 4.4619 |
| Pancreas | 0.0165 | 0.0939 | 0.1760 | 5.6828 |
| Penis | 0.0299 | 0.0267 | 1.1232 | 0.8903 |
| Prostate | 0.0196 | 0.0298 | 0.6580 | 1.5197 |
| Uterus-endometrium | 0.0270 | 0.1583 | 0.1707 | 5.8579 |
| Uterus-myometrium | 0.0229 | 0.0679 | 0.3367 | 2.9702 |
| Uterus-general | 0.0051 | 0.0954 | 0.0534 | 18.7357 |
| Breast hyperplasia | 0.0192 |  |  |  |
| Prostate hyperplasia | 0.0505 |  |  |  |
| Seminal vesicle | 0.0890 |  |  |  |
| Sensory organs | 0.0353 |  |  |  |
| White blood cells | 0.0399 |  |  |  |
| Cervix | 0.0319 |  |  |  |

|  | FETUS % frequency | STANDARDIZED/SUB- TRACTED LIBRARIES % frequency |  |
|---|---|---|---|
| Development | 0.0417 | Breast | 0.0000 |
| Gastrointestinal | 0.0333 | Ovary_n | 0.0000 |
| Brain | 0.0313 | Ovary_t | 0.0152 |
| Hematopoietic | 0.0197 | Endocrine tissue | 0.0000 |
| Skin | 0.0000 | Fetal | 0.0082 |
| Hepatic | 0.0000 | Gastrointestinal | 0.0244 |
| Heart-blood vessels | 0.0783 | Hematopoietic | 0.0057 |
| Lung | 0.0217 | Skin-muscle | 0.0032 |
| Suprarenal gland | 0.0507 | Testicles | 0.0077 |
| Kidney | 0.0309 | Lung | 0.0082 |
| Placenta | 0.0727 | Nerves | 0.0141 |
| Prostate | 0.0997 | Prostate | 0.0000 |
| Sensory organs | 0.0000 | Sensory Organs | 0.0310 |
|  |  | Uterus_n | 0.0125 |

Electronic Northern for SEQ. ID NO.: 128

|  | NORMAL % frequency | TUMOR % frequency | Ratios N/T | T/N |
|---|---|---|---|---|
| Bladder | 0.0039 | 0.0077 | 0.5085 | 1.9666 |
| Breast | 0.0038 | 0.0000 | undef | 0.0000 |
| Small intestine | 0.0031 | 0.0000 | undef | 0.0000 |
| Ovary | 0.0030 | 0.0000 | undef | 0.0000 |
| Endocrine tissue | 0.0068 | 0.0025 | 2.7170 | 0.3681 |
| Gastrointestinal | 0.0019 | 0.0046 | 0.4142 | 2.4145 |
| Brain | 0.0007 | 0.0031 | 0.2400 | 4.1669 |
| Hematopoietic | 0.0013 | 0.0000 | undef | 0.0000 |
| Skin | 0.0000 | 0.0000 | undef | undef |
| Hepatic | 0.0000 | 0.0065 | 0.0000 | undef |
| Heart | 0.0074 | 0.0000 | undef | 0.0000 |
| Testicles | 0.0173 | 0.0117 | 1.4759 | 0.6775 |
| Lung | 0.0021 | 0.0000 | undef | 0.0000 |
| Stomach-esophagus | 0.0000 | 0.0000 | undef | undef |
| Muscle-skeleton | 0.0086 | 0.0000 | undef | 0.0000 |
| Kidney | 0.0081 | 0.0000 | undef | 0.0000 |
| Pancreas | 0.0033 | 0.0000 | undef | 0.0000 |
| Penis | 0.0030 | 0.0000 | undef | 0.0000 |
| Prostate | 0.0022 | 0.0043 | 0.5118 | 1.9538 |

|  | -continued | | |
|---|---|---|---|
| Uterus-endometrium | 0.0135 | 0.1055 | 0.1280 | 7.8106 |
| Uterus-myometrium | 0.0000 | 0.0000 | undef | undef |
| Uterus-general | 0.0051 | 0.0000 | undef | 0.0000 |
| Breast hyperplasia | 0.0000 | | | |
| Prostate hyperplasia | 0.0030 | | | |
| Seminal vesicle | 0.0089 | | | |
| Sensory organs | 0.0325 | | | |
| White blood cells | 0.0026 | | | |
| Cervix | 0.0000 | | | |

|  | FETUS % frequency | STANDARDIZED/SUB-TRACTED LIBRARIES % frequency |  |
|---|---|---|---|
| Development | 0.0139 | Breast | 0.0204 |
| Gastrointestinal | 0.0056 | Ovary_n | 0.0000 |
| Brain | 0.0063 | Ovary_t | 0.0152 |
| Hematopoietic | 0.0079 | Endocrine tissue | 0.0000 |
| Skin | 0.0000 | Fetal | 0.0082 |
| Hepatic | 0.0000 | Gastrointestinal | 0.0122 |
| Heart-blood vessels | 0.0000 | Hematopoietic | 0.0057 |
| Lung | 0.0036 | Skin-muscle | 0.0032 |
| Suprarenal gland | 0.0000 | Testicles | 0.0154 |
| Kidney | 0.0000 | Lung | 0.0164 |
| Placenta | 0.0061 | Nerves | 0.0060 |
| Prostate | 0.0000 | Prostate | 0.0205 |
| Sensory organs | 0.0000 | Sensory Organs | 0.0077 |
|  |  | Uterus_n | 0.0042 |

Electronic Northern for SEQ. ID NO.: 129

|  | NORMAL | TUMOR | Ratios | |
|---|---|---|---|---|
|  | % frequency | % frequency | N/T | T/N |
| Bladder | 0.0000 | 0.0000 | undef | undef |
| Breast | 0.0000 | 0.0019 | 0.0000 | undef |
| Small intestine | 0.0000 | 0.0000 | undef | undef |
| Ovary | 0.0000 | 0.0000 | undef | undef |
| Endocrine tissue | 0.0017 | 0.0000 | undef | 0.0000 |
| Gastrointestinal | 0.0000 | 0.0000 | undef | undef |
| Brain | 0.0007 | 0.0000 | undef | 0.0000 |
| Hematopoietic | 0.0000 | 0.0000 | undef | undef |
| Skin | 0.0037 | 0.0000 | undef | 0.0000 |
| Hepatic | 0.0000 | 0.0000 | undef | undef |
| Heart | 0.0021 | 0.0000 | undef | 0.0000 |
| Testicles | 0.0000 | 0.0000 | undef | undef |
| Lung | 0.0010 | 0.0000 | undef | 0.0000 |
| Stomach-esophagus | 0.0000 | 0.0000 | undef | undef |
| Muscle-skeleton | 0.0000 | 0.0000 | undef | undef |
| Kidney | 0.0027 | 0.0137 | 0.1983 | 5.0439 |
| Pancreas | 0.0017 | 0.0000 | undef | 0.0000 |
| Penis | 0.0000 | 0.0000 | undef | undef |
| Prostate | 0.0022 | 0.0000 | undef | 0.0000 |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0009 | | | |
| Cervix | 0.0000 | | | |

|  | FETUS % frequency | STANDARDIZED/SUB-TRACTED LIBRARIES % frequency |  |
|---|---|---|---|
| Development | 0.0000 | Breast | 0.0000 |
| Gastrointestinal | 0.0028 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0006 |
| Hepatic | 0.0000 | Gastrointestinal | 0.0000 |
| Heart-blood vessels | 0.0000 | Hematopoietic | 0.0000 |
| Lung | 0.0036 | Skin-muscle | 0.0000 |
| Suprarenal gland | 0.0254 | Testicles | 0.0077 |
| Kidney | 0.0000 | Lung | 0.0000 |
| Placenta | 0.0000 | Nerves | 0.0010 |
| Prostate | 0.0000 | Prostate | 0.0068 |
| Sensory organs | 0.0000 | Sensory Organs | 0.0000 |
|  |  | Uterus_n | 0.0000 |

Electronic Northern for SEQ. ID NO.: 130

|  | NORMAL | TUMOR | Ratios | |
|---|---|---|---|---|
|  | % frequency | % frequency | N/T | T/N |
| Bladder | 0.0039 | 0.0051 | 0.7627 | 1.3111 |
| Breast | 0.0013 | 0.0019 | 0.6805 | 1.4694 |
| Small intestine | 0.0031 | 0.0000 | undef | 0.0000 |
| Ovary | 0.0000 | 0.0000 | undef | undef |
| Endocrine tissue | 0.0000 | 0.0025 | undef | undef |
| Gastrointestinal | 0.0000 | 0.0046 | 0.0000 | undef |
| Brain | 0.0000 | 0.0010 | 0.0000 | undef |
| Hematopoietic | 0.0027 | 0.0000 | undef | 0.0000 |
| Skin | 0.0000 | 0.0000 | undef | undef |
| Hepatic | 0.0000 | 0.0000 | undef | undef |
| Heart | 0.0021 | 0.0000 | undef | 0.0000 |
| Testicles | 0.0000 | 0.0000 | undef | undef |
| Lung | 0.0010 | 0.0041 | 0.2540 | 3.9367 |
| Stomach-esophagus | 0.0000 | 0.0000 | undef | undef |
| Muscle-skeleton | 0.0017 | 0.0000 | undef | 0.0000 |
| Kidney | 0.0000 | 0.0068 | 0.0000 | undef |
| Pancreas | 0.0000 | 0.0000 | undef | undef |
| Penis | 0.0000 | 0.0000 | undef | undef |
| Prostate | 0.0000 | 0.0021 | 0.0000 | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0059 | | | |
| Sensory organs | 0.0000 | | | |
| White blood cells | 0.0009 | | | |
| Cervix | 0.0000 | | | |

|  | FETUS % frequency | STANDARDIZED/SUB-TRACTED LIBRARIES % frequency |  |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0000 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0082 |
| Placenta | 0.0000 | Nerves | 0.0000 |
| Prostate | 0.0000 | Prostate | 0.0068 |
| Sensory organs | 0.0000 | Sensory Organs | 0.0000 |
|  |  | Uterus_n | 0.0000 |

Electronic Northern for SEQ. ID NO.: 131

|  | NORMAL | TUMOR | Ratios | |
|---|---|---|---|---|
|  | % frequency | % frequency | N/T | T/N |
| Bladder | 0.0078 | 0.0128 | 0.6102 | 1.6389 |
| Breast | 0.0115 | 0.0169 | 0.6805 | 1.4694 |
| Small intestine | 0.0000 | 0.0165 | 0.0000 | undef |
| Ovary | 0.0060 | 0.0260 | 0.2303 | 4.3431 |
| Endocrine tissue | 0.0153 | 0.0176 | 0.8733 | 1.1451 |
| Gastrointestinal | 0.0019 | 0.0046 | 0.4142 | 2.4145 |
| Brain | 0.0074 | 0.0092 | 0.8000 | 1.2501 |
| Hematopoietic | 0.0080 | 0.0758 | 0.1059 | 9.4460 |
| Skin | 0.0037 | 0.0000 | undef | 0.0000 |
| Hepatic | 0.0095 | 0.0065 | 1.4706 | 0.6800 |
| Heart | 0.0201 | 0.0000 | undef | 0.0000 |
| Testicles | 0.0058 | 0.0234 | 0.2460 | 4.0652 |
| Lung | 0.0114 | 0.0164 | 0.6985 | 1.4315 |
| Stomach-esophagus | 0.0193 | 0.0077 | 2.5211 | 0.3967 |
| Muscle-skeleton | 0.0051 | 0.0120 | 0.4283 | 2.3347 |

| | | | |
|---|---|---|---|
| Kidney | 0.0136 | 0.0137 | 0.9913 | 1.0088 |
| Pancreas | 0.0066 | 0.0110 | 0.5983 | 1.6714 |
| Penis | 0.0030 | 0.0000 | undef | 0.0000 |
| Prostate | 0.0065 | 0.0128 | 0.5118 | 1.9538 |
| Uterus-endometrium | 0.0068 | 0.1055 | 0.0640 | 15.6211 |
| Uterus-myometrium | 0.0076 | 0.0000 | undef | 0.0000 |
| Uterus-general | 0.0051 | 0.0000 | undef | 0.0000 |
| Breast hyperplasia | 0.0096 | | | |
| Prostate hyperplasia | 0.0089 | | | |
| Seminal vesicle | 0.0089 | | | |
| Sensory organs | 0.0118 | | | |
| White blood cells | 0.0009 | | | |
| Cervix | 0.0000 | | | |

| | FETUS % frequency | STANDARDIZED/SUB-TRACTED LIBRARIES % frequency | |
|---|---|---|---|
| Development | 0.0139 | Breast | 0.0204 |
| Gastrointestinal | 0.0000 | Ovary_n | 0.0000 |
| Brain | 0.0000 | Ovary_t | 0.0051 |
| Hematopoietic | 0.0079 | Endocrine tissue | 0.0000 |
| Skin | 0.0000 | Fetal | 0.0099 |
| Hepatic | 0.0260 | Gastrointestinal | 0.0244 |
| Heart-blood vessels | 0.0107 | Hematopoietic | 0.0057 |
| Lung | 0.0108 | Skin-muscle | 0.0259 |
| Suprarenal gland | 0.0000 | Testicles | 0.0077 |
| Kidney | 0.0062 | Lung | 0.0082 |
| Placenta | 0.0424 | Nerves | 0.0090 |
| Prostate | 0.0000 | Prostate | 0.0000 |
| Sensory organs | 0.0000 | Sensory Organs | 0.0000 |
| | | Uterus_n | 0.0167 |

Electronic Northern for SEQ. ID NO.: 132

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0000 | 0.0000 | undef | undef |
| Small intestine | 0.0000 | 0.0000 | undef | undef |
| Ovary | 0.0000 | 0.0000 | undef | undef |
| Endocrine tissue | 0.0000 | 0.0025 | 0.0000 | undef |
| Gastrointestinal | 0.0000 | 0.0000 | undef | undef |
| Brain | 0.0000 | 0.0000 | undef | undef |
| Hematopoietic | 0.0013 | 0.0000 | undef | 0.0000 |
| Skin | 0.0000 | 0.0000 | undef | undef |
| Hepatic | 0.0000 | 0.0000 | undef | undef |
| Heart | 0.0011 | 0.0000 | undef | 0.0000 |
| Testicles | 0.0058 | 0.0000 | undef | 0.0000 |
| Lung | 0.0000 | 0.0000 | undef | undef |
| Stomach-esophagus | 0.0000 | 0.0000 | undef | undef |
| Muscle-skeleton | 0.0000 | 0.0000 | undef | undef |
| Kidney | 0.0000 | 0.0000 | undef | undef |
| Pancreas | 0.0017 | 0.0000 | undef | 0.0000 |
| Penis | 0.0000 | 0.0000 | undef | undef |
| Prostate | 0.0022 | 0.0000 | undef | 0.0000 |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0139 | Breast | 0.0000 |
| Gastrointestinal | 0.0000 | Ovary_n | 0.0000 |
| Brain | 0.0000 | Ovary_t | 0.0051 |
| Hematopoietic | 0.0000 | Endocrine tissue | 0.0000 |
| Skin | 0.0000 | Fetal | 0.0006 |
| Hepatic | 0.0000 | Gastrointestinal | 0.0000 |
| Heart-blood vessels | 0.0000 | Hematopoietic | 0.0057 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0061 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 133

| | NORMAL | TUMOR | Ratios | |
|---|---|---|---|---|
| | % frequency | % frequency | N/T | T/N |
| Bladder | 0.0039 | 0.0051 | 0.7627 | 1.3111 |
| Breast | 0.0141 | 0.0150 | 0.9357 | 1.0687 |
| Small intestine | 0.0184 | 0.0000 | undef | 0.0000 |
| Ovary | 0.0120 | 0.0104 | 1.1513 | 0.8686 |
| Endocrine tissue | 0.0102 | 0.0176 | 0.5822 | 1.7176 |
| Gastrointestinal | 0.0057 | 0.0139 | 0.4142 | 2.4145 |
| Brain | 0.0052 | 0.0072 | 0.7200 | 1.3890 |
| Hematopoietic | 0.0174 | 0.0000 | undef | 0.0000 |
| Skin | 0.0110 | 0.0000 | undef | 0.0000 |
| Hepatic | 0.0000 | 0.0000 | undef | undef |
| Heart | 0.0064 | 0.0000 | undef | 0.0000 |
| Testicles | 0.0058 | 0.0234 | 0.2460 | 4.0652 |
| Lung | 0.0104 | 0.0204 | 0.5080 | 1.9684 |
| Stomach-esophagus | 0.0193 | 0.0153 | 1.2605 | 0.7933 |
| Muscle-skeleton | 0.0086 | 0.0240 | 0.3569 | 2.8016 |
| Kidney | 0.0244 | 0.0000 | undef | 0.0000 |
| Pancreas | 0.0066 | 0.0110 | 0.5983 | 1.6714 |
| Penis | 0.0120 | 0.0267 | 0.4493 | 2.2259 |
| Prostate | 0.0153 | 0.0149 | 1.0236 | 0.9769 |
| Uterus-endometrium | 0.0270 | 0.2111 | 0.1280 | 7.8106 |
| Uterus-myometrium | 0.0305 | 0.0136 | 2.2445 | 0.4455 |
| Uterus-general | 0.0153 | 0.0000 | undef | 0.0000 |
| Breast hyperplasia | 0.0192 | | | |
| Prostate hyperplasia | 0.0327 | | | |
| Seminal vesicle | 0.0178 | | | |
| Sensory organs | 0.0235 | | | |
| White blood cells | 0.0000 | | | |
| Cervix | 0.0319 | | | |

| | FETUS % frequency | STANDARDIZED/SUB-TRACTED LIBRARIES % frequency | |
|---|---|---|---|
| Development | 0.0000 | Breast | 0.0068 |
| Gastrointestinal | 0.0305 | Ovary_n | 0.0000 |
| Brain | 0.0313 | Ovary_t | 0.0253 |
| Hematopoietic | 0.0039 | Endocrine tissue | 0.0245 |
| Skin | 0.0000 | Fetal | 0.0093 |
| Hepatic | 0.0520 | Gastrointestinal | 0.0122 |
| Heart-blood vessels | 0.0107 | Hematopoietic | 0.0000 |
| Lung | 0.0253 | Skin-muscle | 0.0000 |
| Suprarenal gland | 0.0000 | Testicles | 0.0000 |
| Kidney | 0.0309 | Lung | 0.0246 |
| Placenta | 0.0061 | Nerves | 0.0020 |
| Prostate | 0.0000 | Prostate | 0.0068 |
| Sensory organs | 0.0000 | Sensory Organs | 0.0000 |
| | | Uterus_n | 0.0042 |

Electronic Northern for SEQ. ID NO.: 134

| | NORMAL | TUMOR | Ratios | |
|---|---|---|---|---|
| | % frequency | % frequency | N/T | T/N |
| Bladder | 0.0273 | 0.0383 | 0.7119 | 1.4047 |
| Breast | 0.0141 | 0.0244 | 0.5758 | 1.7366 |
| Small intestine | 0.0245 | 0.0331 | 0.7415 | 1.3487 |
| Ovary | 0.0120 | 0.0312 | 0.3838 | 2.6058 |
| Endocrine tissue | 0.0290 | 0.0201 | 1.4434 | 0.6928 |
| Gastrointestinal | 0.0287 | 0.0278 | 1.0354 | 0.9658 |
| Brain | 0.0133 | 0.0298 | 0.4469 | 2.2378 |
| Hematopoietic | 0.0281 | 0.0379 | 0.7411 | 1.3494 |
| Skin | 0.0073 | 0.0847 | 0.0866 | 11.5419 |
| Hepatic | 0.0381 | 0.0259 | 1.4706 | 0.6800 |
| Heart | 0.0191 | 0.1512 | 0.1262 | 7.9265 |

| | NORMAL | TUMOR | | |
|---|---|---|---|---|
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0061 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

-continued

| | | | |
|---|---|---|---|
| Testicles | 0.0173 | 0.0702 | 0.2460 | 4.0652 |
| Lung | 0.0447 | 0.0470 | 0.9498 | 1.0528 |
| Stomach-esophagus | 0.0773 | 0.0153 | 5.0421 | 0.1983 |
| Muscle-skeleton | 0.0668 | 0.0420 | 1.5909 | 0.6286 |
| Kidney | 0.0190 | 0.0342 | 0.0551 | 1.8014 |
| Pancreas | 0.0066 | 0.0331 | 0.1994 | 5.0142 |
| Penis | 0.0150 | 0.1600 | 0.0936 | 10.6842 |
| Prostate | 0.0196 | 0.0149 | 1.3161 | 0.7598 |
| Uterus-endometrium | 0.0068 | 0.1055 | 0.0640 | 15.6211 |
| Uterus-myometrium | 0.0229 | 0.0204 | 1.1223 | 0.8911 |
| Uterus-general | 0.0102 | 0.0000 | undef | 0.0000 |
| Breast hyperplasia | 0.0000 | | | |
| Prostate hyperplasia | 0.0030 | | | |
| Seminal vesicle | 0.0089 | | | |
| Sensory organs | 0.0000 | | | |
| White blood cells | 0.1240 | | | |
| Cervix | 0.0213 | | | |

| | FETUS % frequency | STANDARDIZED/SUB-TRACTED LIBRARIES % frequency | |
|---|---|---|---|
| Development | 0.0000 | Breast | 0.0408 |
| Gastrointestinal | 0.0111 | Ovary_n | 0.0000 |
| Brain | 0.0000 | Ovary_t | 0.0253 |
| Hematopoietic | 0.0118 | Endocrine tissue | 0.0245 |
| Skin | 0.0000 | Fetal | 0.0169 |
| Hepatic | 0.0260 | Gastrointestinal | 0.0244 |
| Heart-blood vessels | 0.0107 | Hematopoietic | 0.0000 |
| Lung | 0.0036 | Skin-muscle | 0.0454 |
| Suprarenal gland | 0.0000 | Testicles | 0.0000 |
| Kidney | 0.0000 | Lung | 0.0164 |
| Placenta | 0.0364 | Nerves | 0.0000 |
| Prostate | 0.0000 | Prostate | 0.0000 |
| Sensory organs | 0.0126 | Sensory Organs | 0.0000 |
| | | Uterus_n | 0.0042 |

Electronic Northern for SEQ. ID NO.: 135

| | NORMAL | TUMOR | Ratios | |
|---|---|---|---|---|
| | % frequency | % frequency | N/T | T/N |
| Bladder | 0.0390 | 0.0383 | 1.0170 | 0.9833 |
| Breast | 0.0102 | 0.0301 | 0.3403 | 2.9389 |
| Small intestine | 0.0429 | 0.0000 | undef | 0.0000 |
| Ovary | 0.0030 | 0.0156 | 0.1919 | 5.2117 |
| Endocrine tissue | 0.0358 | 0.0351 | 1.0189 | 0.9815 |
| Gastrointestinal | 0.0115 | 0.0278 | 0.4142 | 2.4145 |
| Brain | 0.0148 | 0.0226 | 0.6545 | 1.5279 |
| Hematopoietic | 0.0227 | 0.2273 | 0.1000 | 10.0016 |
| Skin | 0.0367 | 0.1695 | 0.2166 | 4.6168 |
| Hepatic | 0.0285 | 0.0582 | 0.4902 | 2.0400 |
| Heart | 0.0445 | 0.0687 | 0.6476 | 1.5441 |
| Testicles | 0.0173 | 0.0234 | 0.7380 | 1.3551 |
| Lung | 0.0291 | 0.0470 | 0.6185 | 1.6169 |
| Stomach-esophagus | 0.0580 | 0.0153 | 3.7816 | 0.2644 |
| Muscle-skeleton | 0.0685 | 0.0840 | 0.8159 | 1.2257 |
| Kidney | 0.0244 | 0.0685 | 0.3569 | 2.8022 |
| Pancreas | 0.0116 | 0.0607 | 0.1904 | 5.2530 |
| Penis | 0.0180 | 0.0000 | undef | 0.0000 |
| Prostate | 0.0131 | 0.0064 | 2.0473 | 0.4885 |
| Uterus-endometrium | 0.0135 | 0.6332 | 0.0213 | 46.8633 |
| Uterus-myometrium | 0.0076 | 0.0408 | 0.1870 | 5.3463 |
| Uterus-general | 0.0051 | 0.0000 | undef | 0.0000 |
| Breast hyperplasia | 0.0128 | | | |
| Prostate hyperplasia | 0.0149 | | | |
| Seminal vesicle | 0.0000 | | | |
| Sensory organs | 0.0000 | | | |
| White blood cells | 0.0867 | | | |
| Cervix | 0.0639 | | | |

| | FETUS % frequency | STANDARDIZED/SUB-TRACTED LIBRARIES % frequency | |
|---|---|---|---|
| Development | 0.0000 | Breast | 0.0068 |
| Gastrointestinal | 0.0167 | Ovary_n | 0.0000 |
| Brain | 0.0000 | Ovary_t | 0.0051 |
| Hematopoietic | 0.0236 | Endocrine tissue | 0.0000 |
| Skin | 0.0000 | Fetal | 0.0035 |
| Hepatic | 0.0000 | Gastrointestinal | 0.0122 |
| Heart-blood vessels | 0.0000 | Hematopoietic | 0.0000 |
| Lung | 0.0000 | Skin-muscle | 0.0032 |
| Suprarenal gland | 0.0000 | Testicles | 0.0077 |
| Kidney | 0.0000 | Lung | 0.0000 |
| Placenta | 0.0182 | Nerves | 0.0030 |
| Prostate | 0.0997 | Prostate | 0.0000 |
| Sensory organs | 0.0000 | Sensory Organs | 0.0464 |
| | | Uterus_n | 0.0000 |

Electronic Northern for SEQ. ID NO.: 136

| | NORMAL | TUMOR | Ratios | |
|---|---|---|---|---|
| | % frequency | % frequency | N/T | T/N |
| Bladder | 0.0000 | 0.0026 | 0.0000 | undef |
| Breast | 0.0102 | 0.0038 | 2.7221 | 0.3674 |
| Small intestine | 0.0092 | 0.0165 | 0.5561 | 1.7982 |
| Ovary | 0.0090 | 0.0078 | 1.1513 | 0.8686 |
| Endocrine tissue | 0.0000 | 0.0150 | 0.0000 | undef |
| Gastrointestinal | 0.0019 | 0.0093 | 0.2071 | 4.8289 |
| Brain | 0.0059 | 0.0031 | 1.9199 | 0.5209 |
| Hematopoietic | 0.0040 | 0.0379 | 0.1059 | 9.4460 |
| Skin | 0.0073 | 0.0000 | undef | 0.0000 |
| Hepatic | 0.0048 | 0.0065 | 0.7353 | 1.3600 |
| Heart | 0.0000 | 0.0000 | undef | undef |
| Testicles | 0.0000 | 0.0117 | 0.0000 | undef |
| Lung | 0.0114 | 0.0041 | 2.7942 | 0.3579 |
| Stomach-esophagus | 0.0097 | 0.0153 | 0.6303 | 1.5866 |
| Muscle-skeleton | 0.0103 | 0.0120 | 0.8567 | 1.1673 |
| Kidney | 0.0081 | 0.0000 | undef | 0.0000 |
| Pancreas | 0.0050 | 0.0000 | undef | 0.0000 |
| Penis | 0.0060 | 0.0000 | undef | 0.0000 |
| Prostate | 0.0000 | 0.0064 | 0.0000 | undef |
| Uterus-endometrium | 0.0068 | 0.1055 | 0.0640 | 15.6211 |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0030 | | | |
| Seminal vesicle | 0.0000 | | | |
| Sensory organs | 0.0000 | | | |
| White blood cells | 0.0104 | | | |
| Cervix | 0.0000 | | | |

| | FETUS % frequency | STANDARDIZED/SUB-TRACTED LIBRARIES % frequency | |
|---|---|---|---|
| Development | 0.0139 | Breast | 0.0068 |
| Gastrointestinal | 0.0056 | Ovary_n | 0.0000 |
| Brain | 0.0000 | Ovary_t | 0.0000 |
| Hematopoietic | 0.0079 | Endocrine tissue | 0.0000 |
| Skin | 0.0000 | Fetal | 0.0076 |
| Hepatic | 0.0000 | Gastrointestinal | 0.0000 |
| Heart-blood vessels | 0.0142 | Hematopoietic | 0.0171 |
| Lung | 0.0108 | Skin-muscle | 0.0000 |
| Suprarenal gland | 0.0254 | Testicles | 0.0000 |
| Kidney | 0.0000 | Lung | 0.0164 |
| Placenta | 0.0061 | Nerves | 0.0060 |
| Prostate | 0.0000 | Prostate | 0.0068 |
| Sensory organs | 0.0126 | Sensory Organs | 0.0000 |
| | | Uterus_n | 0.0125 |

Electronic Northern for SEQ. ID NO.: 137

| | NORMAL | TUMOR | Ratios | |
|---|---|---|---|---|
| | % frequency | % frequency | N/T | T/N |
| Bladder | 0.0000 | 0.0000 | undef | undef |
| Breast | 0.0013 | 0.0000 | undef | 0.0000 |
| Small intestine | 0.0000 | 0.0000 | undef | undef |
| Ovary | 0.0000 | 0.0000 | undef | undef |
| Endocrine tissue | 0.0000 | 0.0000 | undef | undef |
| Gastrointestinal | 0.0000 | 0.0000 | undef | undef |
| Brain | 0.0000 | 0.0000 | undef | undef |

-continued

| | | | |
|---|---|---|---|
| Hematopoietic | 0.0000 | 0.0000 | undef | undef |
| Skin | 0.0000 | 0.0000 | undef | undef |
| Hepatic | 0.0000 | 0.0000 | undef | undef |
| Heart | 0.0000 | 0.0000 | undef | undef |
| Testicles | 0.0000 | 0.0000 | undef | undef |
| Lung | 0.0000 | 0.0000 | undef | undef |
| Stomach-esophagus | 0.0000 | 0.0000 | undef | undef |
| Muscle-skeleton | 0.0017 | 0.0000 | undef | 0.0000 |
| Kidney | 0.0000 | 0.0000 | undef | undef |
| Pancreas | 0.0000 | 0.0000 | undef | undef |
| Penis | 0.0000 | 0.0000 | undef | undef |
| Prostate | 0.0000 | 0.0000 | undef | undef |
| Uterus-endometrium | 0.0000 | 0.1055 | 0.0000 | undef |
| Uterus-myometrium | 0.0000 | 0.0000 | undef | undef |
| Uterus-general | 0.0000 | 0.0000 | undef | undef |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0000 | Ovary_n | 0.0000 |
| Brain | 0.0000 | Ovary_t | 0.0000 |
| Hematopoietic | 0.0000 | Endocrine tissue | 0.0000 |
| Skin | 0.0000 | Fetal | 0.0006 |
| Hepatic | 0.0000 | Gastrointestinal | 0.0000 |
| Heart-blood vessels | 0.0000 | Hematopoietic | 0.0000 |
| Lung | 0.0000 | Skin-muscle | 0.0000 |
| Suprarenal gland | 0.0000 | Testicles | 0.0000 |
| Kidney | 0.0000 | Lung | 0.0000 |
| Placenta | 0.0000 | Nerves | 0.0000 |
| Prostate | 0.0000 | Prostate | 0.0000 |
| Sensory organs | 0.0000 | Sensory Organs | 0.0000 |
| | | Uterus_n | 0.0000 |

Electronic Northern for SEQ. ID NO.: 138

| | NORMAL % frequency | TUMOR % frequency | Ratios N/T | Ratios T/N |
|---|---|---|---|---|
| Bladder | 0.0156 | 0.0051 | 3.0509 | 0.3278 |
| Breast | 0.0000 | 0.0038 | 0.0000 | undef |
| Small intestine | 0.0000 | 0.0331 | 0.0000 | undef |
| Ovary | 0.0000 | 0.0052 | 0.0000 | undef |
| Endocrine tissue | 0.0051 | 0.0050 | 1.0189 | 0.9815 |
| Gastrointestinal | 0.0077 | 0.0139 | 0.5522 | 1.8109 |
| Brain | 0.0059 | 0.0062 | 0.9599 | 1.0417 |
| Hematopoietic | 0.0040 | 0.0000 | undef | 0.0000 |
| Skin | 0.0000 | 0.0000 | undef | undef |
| Hepatic | 0.0048 | 0.0065 | 0.7353 | 1.3600 |
| Heart | 0.0085 | 0.0275 | 0.3084 | 3.2426 |
| Testicles | 0.0000 | 0.0234 | 0.0000 | undef |
| Lung | 0.0062 | 0.0143 | 0.4355 | 2.2964 |
| Stomach-esophagus | 0.0097 | 0.0000 | undef | 0.0000 |
| Muscle-skeleton | 0.0137 | 0.0000 | undef | 0.0000 |
| Kidney | 0.0000 | 0.0000 | undef | undef |
| Pancreas | 0.0033 | 0.0276 | 0.1197 | 8.3571 |
| Penis | 0.0120 | 0.0000 | undef | 0.0000 |
| Prostate | 0.0000 | 0.0064 | 0.0000 | undef |
| Uterus-endometrium | 0.0000 | 0.1055 | 0.0000 | undef |
| Uterus-myometrium | 0.0152 | 0.0068 | 2.2445 | 0.4455 |
| Uterus-general | 0.0051 | 0.0000 | undef | 0.0000 |
| Breast hyperplasia | 0.0064 | | | |
| Prostate hyperplasia | 0.0030 | | | |
| Seminal vesicle | 0.0000 | | | |
| Sensory organs | 0.0000 | | | |
| White blood cells | 0.0087 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0272 |
| Gastrointestinal | 0.0028 | Ovary_n | 0.0000 |
| Brain | 0.0000 | Ovary_t | 0.0253 |
| Hematopoietic | 0.0118 | Endocrine tissue | 0.0000 |
| Skin | 0.0000 | Fetal | 0.0151 |
| Hepatic | 0.0000 | Gastrointestinal | 0.0000 |
| Heart-blood vessels | 0.0107 | Hematopoietic | 0.0057 |
| Lung | 0.0108 | Skin-muscle | 0.0356 |
| Suprarenal gland | 0.0000 | Testicles | 0.0000 |
| Kidney | 0.0000 | Lung | 0.0000 |
| Placenta | 0.0242 | Nerves | 0.0090 |
| Prostate | 0.0249 | Prostate | 0.0068 |
| Sensory organs | 0.0000 | Sensory Organs | 0.0077 |
| | | Uterus_n | 0.0042 |

Electronic Northern for SEQ. ID NO.: 139

| | NORMAL % frequency | TUMOR % frequency | Ratios N/T | Ratios T/N |
|---|---|---|---|---|
| Bladder | 0.0000 | 0.0000 | undef | undef |
| Breast | 0.0013 | 0.0056 | 0.2268 | 4.4083 |
| Small intestine | 0.0061 | 0.0165 | 0.3707 | 2.6973 |
| Ovary | 0.0120 | 0.0052 | 2.3025 | 0.4343 |
| Endocrine tissue | 0.0017 | 0.0025 | 0.6792 | 1.4722 |
| Gastrointestinal | 0.0077 | 0.0046 | 1.6567 | 0.6036 |
| Brain | 0.0000 | 0.0021 | 0.0000 | undef |
| Hematopoietic | 0.0067 | 0.0000 | undef | 0.0000 |
| Skin | 0.0000 | 0.0000 | undef | undef |
| Hepatic | 0.0000 | 0.0000 | undef | undef |
| Heart | 0.0000 | 0.0275 | 0.0000 | undef |
| Testicles | 0.0000 | 0.0000 | undef | undef |
| Lung | 0.0000 | 0.0041 | 0.0000 | undef |
| Stomach-esophagus | 0.0000 | 0.0000 | undef | undef |
| Muscle-skeleton | 0.0017 | 0.0060 | 0.2856 | 3.5020 |
| Kidney | 0.0054 | 0.0000 | undef | 0.0000 |
| Pancreas | 0.0017 | 0.0000 | undef | 0.0000 |
| Penis | 0.0060 | 0.0000 | undef | 0.0000 |
| Prostate | 0.0044 | 0.0064 | 0.6824 | 1.4654 |
| Uterus-endometrium | 0.0000 | 0.1055 | 0.0000 | undef |
| Uterus-myometrium | 0.0076 | 0.0000 | undef | 0.0000 |
| Uterus-general | 0.0000 | 0.0000 | undef | undef |
| Breast hyperplasia | 0.0032 | | | |
| Prostate hyperplasia | 0.0030 | | | |
| Seminal vesicle | 0.0000 | | | |
| Sensory organs | 0.0235 | | | |
| White blood cells | 0.0000 | | | |
| Cervix | 0.0000 | | | |

| | FETUS % frequency | STANDARDIZED/SUB-TRACTED LIBRARIES % frequency | |
|---|---|---|---|
| Development | 0.0000 | Breast | 0.0000 |
| Gastrointestinal | 0.0056 | Ovary_n | 0.0000 |
| Brain | 0.0063 | Ovary_t | 0.0051 |
| Hematopoietic | 0.0000 | Endocrine tissue | 0.0245 |
| Skin | 0.0000 | Fetal | 0.0041 |
| Hepatic | 0.0000 | Gastrointestinal | 0.0244 |
| Heart-blood vessels | 0.0036 | Hematopoietic | 0.0000 |
| Lung | 0.0036 | Skin-muscle | 0.0032 |
| Suprarenal gland | 0.0000 | Testicles | 0.0000 |
| Kidney | 0.0000 | Lung | 0.0164 |
| Placenta | 0.0000 | Nerves | 0.0010 |
| Prostate | 0.0000 | Prostate | 0.0137 |
| Sensory organs | 0.0251 | Sensory Organs | 0.0000 |
| | | Uterus_n | 0.0000 |

-continued

Electronic Northern for SEQ. ID NO.: 140

| | NORMAL | TUMOR | Ratios | |
|---|---|---|---|---|
| | % frequency | % frequency | N/T | T/N |
| Bladder | 0.0039 | 0.0000 | undef | 0.0000 |
| Breast | 0.0051 | 0.0094 | 0.5444 | 1.8368 |
| Small intestine | 0.0000 | 0.0000 | undef | undef |
| Ovary | 0.0090 | 0.0000 | undef | 0.0000 |
| Endocrine tissue | 0.0085 | 0.0100 | 0.8491 | 1.1778 |
| Gastrointestinal | 0.0077 | 0.0000 | undef | 0.0000 |
| Brain | 0.0015 | 0.0041 | 0.3600 | 2.7779 |
| Hematopoietic | 0.0040 | 0.0000 | undef | 0.0000 |
| Skin | 0.0110 | 0.0000 | undef | 0.0000 |
| Hepatic | 0.0000 | 0.0000 | undef | undef |
| Heart | 0.0011 | 0.0137 | 0.0771 | 12.9706 |
| Testicles | 0.0058 | 0.0117 | 0.4920 | 2.0326 |
| Lung | 0.0042 | 0.0020 | 2.0321 | 0.4921 |
| Stomach-esophagus | 0.0000 | 0.0153 | 0.0000 | undef |
| Muscle-skeleton | 0.0034 | 0.0060 | 0.5711 | 1.7510 |
| Kidney | 0.0000 | 0.0000 | undef | undef |
| Pancreas | 0.0017 | 0.0110 | 0.1496 | 6.6857 |
| Penis | 0.0000 | 0.0000 | undef | undef |
| Prostate | 0.0044 | 0.0043 | 1.0236 | 0.9769 |
| Uterus-endometrium | 0.0000 | 0.1055 | 0.0000 | undef |
| Uterus-myometrium | 0.0000 | 0.0068 | 0.0000 | undef |
| Uterus-general | 0.0153 | 0.0000 | undef | 0.0000 |
| Breast hyperplasia | 0.0000 | | | |
| Prostate hyperplasia | 0.0030 | | | |
| Seminal vesicle | 0.0089 | | | |
| Sensory organs | 0.0118 | | | |
| White blood cells | 0.0026 | | | |
| Cervix | 0.0000 | | | |

| | FETUS % frequency | STANDARDIZED/SUB-TRACTED LIBRARIES % frequency |
|---|---|---|
| Development | 0.0000 | Breast 0.0204 |
| Gastrointestinal | 0.0056 | Ovary_n 0.0000 |
| Brain | 0.0063 | Ovary_t 0.0051 |
| Hematopoietic | 0.0000 | Endocrine tissue 0.0000 |
| Skin | 0.0000 | Fetal 0.0116 |
| Hepatic | 0.0000 | Gastrointestinal 0.0122 |
| Heart-blood vessels | 0.0000 | Hematopoietic 0.0000 |
| Lung | 0.0036 | Skin-muscle 0.0130 |
| Suprarenal gland | 0.0000 | Testicles 0.0000 |
| Kidney | 0.0062 | Lung 0.0164 |
| Placenta | 0.0061 | Nerves 0.0060 |
| Prostate | 0.0000 | Prostate 0.0000 |
| Sensory organs | 0.0000 | Sensory Organs 0.0000 |
| | | Uterus_n 0.0000 |

Electronic Northern for SEQ. ID NO.: 141

| | NORMAL | TUMOR | Ratios | |
|---|---|---|---|---|
| | % frequency | % frequency | N/T | T/N |
| Bladder | 0.0000 | 0.0051 | 0.0000 | undef |
| Breast | 0.0064 | 0.0150 | 0.4253 | 2.3511 |
| Small intestine | 0.0000 | 0.0496 | 0.0000 | undef |
| Ovary | 0.0060 | 0.0026 | 2.3025 | 0.4343 |
| Endocrine tissue | 0.0068 | 0.0050 | 1.3585 | 0.7361 |
| Gastrointestinal | 0.0096 | 0.0046 | 2.0708 | 0.4829 |
| Brain | 0.0052 | 0.0051 | 1.0079 | 0.9921 |
| Hematopoietic | 0.0040 | 0.0000 | undef | 0.0000 |
| Skin | 0.0037 | 0.0000 | undef | 0.0000 |
| Hepatic | 0.0000 | 0.0000 | undef | undef |
| Heart | 0.0053 | 0.0000 | undef | 0.0000 |
| Testicles | 0.0000 | 0.0000 | undef | undef |
| Lung | 0.0083 | 0.0061 | 1.3548 | 0.7381 |
| Stomach-esophagus | 0.0000 | 0.0153 | 0.0000 | undef |
| Muscle-skeleton | 0.0103 | 0.0000 | undef | 0.0000 |
| Kidney | 0.0027 | 0.0068 | 0.3965 | 2.5219 |
| Pancreas | 0.0033 | 0.0055 | 0.5983 | 1.6714 |
| Penis | 0.0120 | 0.0267 | 0.4493 | 2.2259 |
| Prostate | 0.0000 | 0.0021 | 0.0000 | undef |
| Uterus-endometrium | 0.0068 | 0.1055 | 0.0640 | 15.6211 |
| Uterus-myometrium | 0.0076 | 0.0000 | undef | 0.0000 |
| Uterus-general | 0.0153 | 0.0000 | undef | 0.0000 |
| Breast hyperplasia | 0.0000 | | | |
| Prostate hyperplasia | 0.0000 | | | |
| Seminal vesicle | 0.0000 | | | |
| Sensory organs | 0.0000 | | | |
| White blood cells | 0.0087 | | | |
| Cervix | 0.0000 | | | |

| | FETUS % frequency | STANDARDIZED/SUB-TRACTED LIBRARIES % frequency |
|---|---|---|
| Development | 0.0000 | Breast 0.0136 |
| Gastrointestinal | 0.0139 | Ovary_n 0.0000 |
| Brain | 0.0000 | Ovary_t 0.0101 |
| Hematopoietic | 0.0039 | Endocrine tissue 0.0000 |
| Skin | 0.0000 | Fetal 0.0082 |
| Hepatic | 0.0000 | Gastrointestinal 0.0000 |
| Heart-blood vessels | 0.0071 | Hematopoietic 0.0000 |
| Lung | 0.0000 | Skin-muscle 0.0032 |
| Suprarenal gland | 0.0000 | Testicles 0.0154 |
| Kidney | 0.0000 | Lung 0.0082 |
| Placenta | 0.0061 | Nerves 0.0040 |
| Prostate | 0.0000 | Prostate 0.0068 |
| Sensory organs | 0.0000 | Sensory Organs 0.0000 |
| | | Uterus_n 0.0000 |

2.2. Fisher Test

In order to decide whether a partial sequence S of a gene occurs significantly more often or less often in a library for normal tissue than in a library for degenerated tissue, Fisher's exact test, a standard statistical process, is carried out (Hays, W. L., (1991) Statistics, Harcourt Brace College Publishers, Fort Worth).

The null hypothesis reads: The two libraries cannot be distinguished with respect to the frequency of sequences homologous to S. If the null hypothesis can be rejected with high enough certainty, the gene belonging to S is accepted as an advantageous candidate for a cancer gene, and in the next step an attempt is made to achieve lengthening of its sequence.

EXAMPLE 3

Automatic Lengthening of the Partial Sequence

Automatic lengthening of partial sequence S is completed in three steps:
1. Determination of all sequences homologous to S from the total set of available sequences using BLAST
2. Assembling these sequences by means of the standard program GAP4 (Bonfield, J. K.; Smith, K. F. and Staden, R. (1995), Nucleic Acids Research 23 4992–4999) (contig formation).
3. Computation of a consensus sequence C from the assembled sequences.

Consensus sequence C will generally be longer than initial sequence S. Its electronic Northern Blot will accordingly deviate from that for S. A repeated Fisher test decides whether the alternative hypothesis of deviation from a uniform expression in the two libraries can be maintained. If this is the case, an attempt is made to lengthen C in the same way as S. This iteration is continued with consensus sequences $C_i$ (i: iteration index) obtained in each case until the alternative hypothesis is rejected (if $H_0$ Exit; truncation criterion I) or until automatic lengthening is no longer possible (while $C_i > C_{i-1}$; truncation criterion II).

In the case of truncation criterion II, with the consensus sequence present after the last iteration, a complete or roughly complete sequence of a gene which can be related to cancer with high statistical certainty is acquired.

Analogously to the above-described examples, it was possible to find from uterus tumor tissue the nucleic acid sequences described in Table I.

Furthermore, for the individual nucleic acid sequences, it was possible to determine the peptide sequences (ORF's) that are listed in Table II, in which no peptide can be assigned to a few nucleic acid sequences and more than one peptide can be assigned to some nucleic acid sequences. As already mentioned above, both the determined nucleic acid sequences and the peptide sequences assigned to the nucleic acid sequences are the subject of this invention.

EXAMPLE 4

Mapping of Nucleic Acid Sequences on the Human Genome

Human genes were mapped using the Stanford G3 Hybrid Panel (Stewart et al., 1997), which is marketed by Research Genetics, Huntsville, Ala. This panel consists of 83 different genomic DNAs of human-hamster hybrid cell lines and allows resolution of 500 kilobases. The hybrid cell lines were obtained by fusion of irradiated diploid human cells with cells of the Chinese hamster. The retention pattern of the human chromosome fragments is determined by means of gene-specific primers in a polymerase chain reaction and is analyzed using software available from the Stanford RH server (http://www.stanford.edu/RH/rhserver_form2.html).

This program determines the STS marker that is nearest to the desired gene. The corresponding cytogenetic band was determined using the "Mapview" program of the Genome Database (GDB), (http://gdbwww.dkfz-heidelberg.de).

In addition to mapping of genes on the human chromosome set by various experimental methods, it is possible to determine the location of genes on this by biocomputer methods. To do this, the known program e-PCR was used (Schuler GD (1998) Electronic PCR: Bridging the Gap between Genome Mapping and Genome Sequencing. Trends Biotechnol 16: 456–459, Schuler GD (1997). Sequence Mapping by Electronic PCR. Genome Res. 7: 541–550). The database used here no longer corresponds to the one cited in the literature, but is a further development which includes data from the public database RHdb (http://www.ebi.ac.uk/RHdb/-index.html). Analogously to the mapping by the hybrid panels, the results were evaluated with the above-mentioned software and the software of the Whitehead Institute (http://carbon.wi.mit.edu:8000/cgi-bin/contig/rhmapper.pl).

References to the modules:

Pfam: Protein families database of alignments and HMMs (pfam@sanger.ac.uk)

PROSITE: The PROSITE database, its status in 1999. Nucleic Acids Res. 27: 215–219 (http://www.expasy.ch/sprot/prosite.html)

TABLE I

Col. 1 - Sequence ID No.:
Col. 2 - Expression in the endometrial tumor:
Col. 3 - Function
Col. 4 - Modules
Col. 5 - Length of the applied sequence in bases
Col. 6 - Cytogenetic localization
Col. 7 - Next marker
[Key to Table I:]
[Col. 2:]
[Seq. ID Nos. 1–62] erhöht = elevated
[Col. 3:]
[Seq. ID Nos.: 1, 7–15, 78–126, 136] unbekannt = unknown
[Seq. ID Nos.: 3, 4, 38, 67–72] Homolog zu . . . = homologous to . . .
[Seq. ID Nos.: 531–555] Verlängerung von Seq. ID No. . . . = Lengthening of Seq. ID No. . . .

| Sequenz ID No.: | Expression im Endometrium Tumor: | Funktion | Module | Länge der angemeldeten Sequenz in Basen | Cytogenetische Lokalisation | nächster Marker |
|---|---|---|---|---|---|---|
| 1 | erhöht | unbekannt | | 1046 | 2p24–2p21 | D2S174–D2S390 |
| 2 | erhöht | Mouse mammary tumor virus proviral envelope gene Polymerase protein | 2x "CSD" | 373 | | |
| 3 | erhöht | Homolog zu Human protein kinase C-binding protein RACK17 | | 1571 | 1q32.1 | D1S477–D1S504 |
| 4 | erhöht | Homolog zu Human mRNA for KIAA0079 | | 1789 | 10q21.3–q22.2 | D10S537–D10S218 |
| 5 | erhöht | Caenorhabditis elegans cosmid T23B12 | "BTB" | 2361 | | |
| 6 | erhöht | Caenorhabditis elegans cosmid C01A2 | | 1638 | 20q13.32–q13.33 | D20S100–D20S173 |
| 7 | erhöht | unbekannt | | 1034 | 12q12 | D12S1589–D12S85 |
| 8 | erhöht | unbekannt | | 947 | 17p11.2–p12 | AFMa126yd5 |
| 9 | erhöht | unbekannt | | 497 | | |
| 10 | erhöht | unbekannt | | 269 | | |
| 11 | erhöht | unbekannt | | 1717 | | |
| 12 | erhöht | unbekannt | "zf-C3HC4" | 1419 | | |
| 13 | erhöht | unbekannt | | 671 | 2q37.3 | D2S2704 |
| 14 | erhöht | unbekannt | | 524 | | |
| 15 | erhöht | unbekannt | | 345 | | |
| 16 | erhöht | rGSTK1-1 = glutahione S-transferase subunit 13 | | 1060 | 7q33–7q36.1 | WI-9353 |
| 17 | erhöht | Rattus norvegicus neuritin | | 1721 | 6p23–p25.1 | D6S1617–D6S1674 |
| 18 | erhöht | Rattus norvegicus cytosolic NADP-dependent isocitrate dehydrogenase | "isodh" | 2367 | 2q34 | WI-1247 |
| 19 | erhöht | Rat unr mRNA for unr protein with unknown function | 2x "CSD" | 1321 | 1p13.3–1q11 | D1S418–D1S252 |

TABLE I-continued

| | | | | | | |
|---|---|---|---|---|---|---|
| 20 | erhöht | Rat prostatic binding protein polypeptide c1 | | 384 | | |
| 21 | erhöht | Rat GTP-binding protein (ral B) | | 367 | | |
| 22 | erhöht | R. norvegicus mRNA for TRAP-complex gamma subunit | | 2621 | 3q24–q25.2 | D3S1570 |
| 23 | erhöht | P. sativum mRNA for Cop1 protein | 2x "G-beta" | 2019 | 1q23.3–q24.3 | D1S242–D1S416 |
| 24 | erhöht | P. falciparum pfmdr1 gene | | 1866 | 18q12.1–q12.3 | AFM164ya9 |
| 25 | erhöht | ORF 5' of ECLF2 . . . ECRF3 = G protein-coupled receptor homolog | | 1189 | | |
| 26 | erhöht | O. cuniculus lambda-crystallin mRNA | "3HCDH" | 1418 | | |
| 27 | erhöht | Mus musculus flotillin | | 814 | | |
| 28 | erhöht | Mouse glycerol-3-phosphate acyltransferase | | 3039 | 10q25.1–q25.2 | D10S1465 |
| 29 | erhöht | Mouse clathrin-associated protein (AP47) | "Adap_comp_sub" | 1448 | | |
| 30 | erhöht | Lycopersicon esculentum biotin-containing subunit of methylcrotonyl-CoA carboxylase | "CPSase_L_chain", "biotin_req_enzy" | 1394 | | |
| 31 | erhöht | Leucine aminopeptidase, bovine | "Peptidase_M17" | 734 | | |
| 32 | erhöht | Klebsiella pneumoniae possible RNA helicase (deaD) | 2x "DEAD" | 692 | | |
| 33 | erhöht | Human mammaglobin Homolog | "Uteroglobin" | 517 | | |
| 34 | erhöht | Human DNA sequence from PAC 138A5 on chromosome X | | 322 | | |
| 35 | erhöht | Human DNA sequence from clone 230G1 | | 1559 | | |
| 36 | erhöht | Human DNA sequence from clone 217C2 | | 1072 | | |
| 37 | erhöht | Human Cosmid Clone 26a1 | "RhoGAP" | 454 | 22.q11.21–q11.23 | D22S420–D22S446 |
| 38 | erhöht | Homolog zu Human chromosome 3p21.1 gene sequence | | 700 | 3p21.1 | |
| 39 | erhöht | Homo sapiens DNA from chromosome 19-cosmid f21246 | | 914 | | |
| 40 | erhöht | H. sapiens mRNA for Ptg-1 protein | | 1669 | 17q21.31–q21.33 | D17S791–D17S797 |
| 41 | erhöht | H. sapiens CpG island DNA genomic Mse1 fragment | | 355 | | |
| 42 | erhöht | H. sapiens (TL5) mRNA from LNCaP cell line | | 2628 | 3q24 | D3S3413 |
| 43 | erhöht | Genomic sequence from Human 9q34 | | 2535 | 9q34.11–q34.13 | D9S179–D9S164 |
| 44 | erhöht | Drosophila melanogaster misato gene | "MYB_3" | 805 | 1q21.2 | D1S305–D1S506 |
| 45 | erhöht | Chicken mRNA for vitellogenin I | | 1279 | | |
| 46 | erhöht | Caenorhabditis elegans DNA from clone F31D4 | | 1923 | | |
| 47 | erhöht | Caenorhabditis elegans cosmid ZK863 | | 706 | | |
| 48 | erhöht | Caenorhabditis elegans cosmid ZK863 | | 749 | | |
| 49 | erhöht | Caenorhabditis elegans cosmid ZK596 | | 857 | 10q26.13 | D10S212 |
| 50 | erhöht | Caenorhabditis elegans cosmid T26A5 | | 268 | | |
| 51 | erhöht | Caenorhabditis elegans cosmid T21G5 | | 297 | | |
| 52 | erhöht | Caenorhabditis elegans cosmid F56D5 | | 590 | | |
| 53 | erhöht | Caenorhabditis elegans cosmid F25D7 | | 1714 | | |
| 54 | erhöht | Caenorhabditis elegans cosmid F08C6 | | 1340 | | |
| 55 | erhöht | C. botulinum bont (partial) and ntnh genes | | 765 | 3q24–q23 | D3S3409 |
| 56 | erhöht | Bovine mRNA fragment for 40 kDa subunit of mitochondrial NADH:ubiquinone oxidoreductase (EC 1.6.5.3) | "complex 1_4 9Kd" | 1647 | | |
| 57 | erhöht | Bos taurus (clone pTKD7) dopamine and cyclic AMP-regulated neuronal phosphonprotein (DARPP-32) | | 1166 | | |
| 58 | erhöht | A. thaliana mRNA for RNA helicase | | 487 | | |
| 59 | erhöht | A. thaliana glycine-rich protein (clone atGRP-4) | | 1630 | 5q23.3–q31.1 | D5S396–D5S2119 |
| 60 | erhöht | Saccharomyces cerevisiae Grd19p (GRD19) | 2x "PX"; "BEM_DOMAIN" | 1272 | 6q21 | AFMa191wd1 |
| 61 | erhöht | Saccharomyces cerevisiae chromosome XII cosmid 9328 | 2x "DEAD"; "helicase_C" | 1914 | 7p12.3—p13 | D7S667–D7S2427 |
| 62 | erhöht | S. pombe chromosome I cosmid c13D6 | | 608 | | |
| 63 | | Rattus norvegicus RNA helicase with arginine-serine-rich domain | | 2674 | 17q21.31–q22 | D17S797–D17S788 |
| 64 | | Rattus norvegicus matrilysin (MMP-7) mRNA | | 326 | | |
| 65 | | Rattus norvegicus Diphor-1 | 2x "PDZ" | 888 | 1q12 | D1S2669–D1S498 |
| 66 | | Human herpesvirus-7 (HHV7) JI, G protein-coupled receptor (GCR) | | 202 | | |
| 67 | | Homolog zu Human synapsin I (SYN1) | | 1225 | 1p22.3–p31.1 | WI-3099 |
| 68 | | Homolog zu Human PAX3 gene | | 1093 | | |
| 69 | | Homolog zu Human multiple exostosis 2 (EXT2) | | 309 | 1p21.3–p22.1 | D1S2166 |
| 70 | | Homolog zu Homo sapiens integrin variant beta4E (ITGB4) | | 380 | | |
| 71 | | Homolog zu Homo sapiens hCPE-R mRNA for CPE-receptor | | 1253 | | |

TABLE I-continued

| | | | | | |
|---|---|---|---|---|---|
| 72 | Homolog zu *H. sapiens* mRNA for deoxyguanosine kinase | | 439 | | |
| 73 | *Caenorhabditis elegans* cosmid Y48E1B | | 1252 | 4p11–q12 | D4S1619–D4S1600 |
| 74 | *Caenorhabditis elegans* cosmid T21D12 | "WW_DOMAIN_2" | 695 | | |
| 75 | *Caenorhabditis elegans* cosmid R107 | | 2514 | 13q33.3–q34 | D13S261–D13S293 |
| 76 | *Caenorhabditis elegans* cosmid M04C9 | | 274 | | |
| 77 | Bovine opsin | "7tm_1" | 449 | | |
| 78 | unbekannt | | 346 | | |
| 79 | unbekannt | | 1329 | | |
| 80 | unbekannt | | 805 | | |
| 81 | unbekannt | | 420 | | |
| 82 | unbekannt | | 2143 | 9q21.32–q22.1 | D9S264–D9S257 |
| 83 | unbekannt | | 450 | | |
| 84 | unbekannt | | 408 | 17q23.1–q23.2 | D17S1680 |
| 85 | unbekannt | | 311 | | |
| 86 | unbekannt | | 487 | | |
| 87 | unbekannt | | 1902 | 11p12–p13 | WI-6150 |
| 88 | unbekannt | | 1048 | 1q42.11–q43 | WI-9317 |
| 89 | unbekannt | | 804 | | |
| 90 | unbekannt | | 581 | | |
| 91 | unbekannt | | 2042 | | |
| 92 | unbekannt | | 430 | | |
| 93 | unbekannt | | 592 | | |
| 94 | unbekannt | | 674 | | |
| 95 | unbekannt | | 324 | | |
| 96 | unbekannt | | 709 | 5p15.33 | D5S1954 |
| 97 | unbekannt | | 592 | | |
| 98 | unbekannt | | 1948 | 16p13.2—p12.3 | D16S499 |
| 99 | unbekannt | | 483 | | |
| 100 | unbekannt | | 437 | | |
| 101 | unbekannt | | 359 | | |
| 102 | unbekannt | | 501 | | |
| 103 | unbekannt | | 1102 | 1q23.1–q23.2 | D1S445–D1S431 |
| 104 | unbekannt | | 306 | | |
| 105 | unbekannt | | 2042 | | |
| 106 | unbekannt | | 320 | | |
| 107 | unbekannt | | 506 | | |
| 108 | unbekannt | | 1276 | | |
| 109 | unbekannt | | 373 | | |
| 110 | unbekannt | TPR_REPEAT" | 492 | | |
| 111 | unbekannt | | 1678 | 6q21 | D6S278–D6S302 |
| 112 | unbekannt | | 866 | 9q22.1–q22.2 | D9S1841–D9S196 |
| 113 | unbekannt | | 1434 | 18q12.1–q12.3 | D18S1124–D18S468 |
| 114 | unbekannt | | 914 | 7q32.3 | D7S686–D7S530 |
| 115 | unbekannt | | 685 | 8p12–p11.23 | D8S1821–D8S255 |
| 116 | unbekannt | | 2646 | | |
| 117 | unbekannt | | 2667 | | |
| 118 | unbekannt | | 544 | | |
| 119 | unbekannt | | 1340 | 18p11.21 | D18S471–D18S464 |
| 120 | unbekannt | | 2376 | | |
| 121 | unbekannt | | 225 | | |
| 122 | unbekannt | | 1967 | 6q22.33–q23.1 | D6S292–D6S1699 |
| 123 | unbekannt | | 612 | | |
| 124 | unbekannt | | 1183 | 2q32.3–q34 | D2S315–D2S2237 |
| 125 | unbekannt | | 891 | 4q28.1–q31.1 | |
| 126 | unbekannt | | 482 | | |
| 127 | Human triosephosphate isomerase mRNA | | 610 | | |
| 128 | Human ras inhibitor mRNA | | 2072 | 9q33.3–q34.11 | |
| 129 | Human R kappa B | | 980 | | |
| 130 | Human putative interferon-related protein (SM15) | | 192 | | |
| 131 | Human protein trafficking protein (S31iii125) | 2x "EMP24_GP25L" | 1092 | 14q32.2–14q32.33 | WI-9179 |
| 132 | Human protein kinase C-binding protein RACK7 | | 1523 | 20q13.13–q13.2 | D20S957 |
| 133 | Human gene for histone H1(0) | "linker_histone" | 2241 | 22q13.1 | |
| 134 | Human cathepsin B proteinase | "Cys-protease" | 631 | | |
| 135 | *Homo sapiens* cathepsin B mRNA | "Cys-protease" | 980 | | |
| 136 | unbekannt | | 2238 | 14q24.1–14q24.3 | D14S277 |
| 137 | *H. sapiens* XG mRNA | | 398 | | |
| 138 | *H. sapiens* mRNA for RAB7 protein | ras | 1084 | 7q21.3–q22.1 | D7S652 |
| 139 | *H. sapiens* mRNA for pyrroline 5-carboxylate synthetase | | 1259 | | |

TABLE I-continued

| | | | | | |
|---|---|---|---|---|---|
| 140 | H. sapiens mRNA for beta-1,4-galactosyl-transferase | | 1938 | 1q22–q23.1 | |
| 141 | H. sapiens IL-13Ra | | 1874 | Xq23 | |
| 531 | Verlängerung von Seq. ID No. 19 | 2x "CSD" | 1708 | 1p13.3–1q11 | D1S418–D1S252 |
| 532 | Verlängerung von Seq. ID No. 23 | 2x "G-beta" | 2128 | 1q23.3–q24.3 | D1S242–D1S416 |
| 533 | Verlängerung von Seq. ID No. 25 | | 2640 | | |
| 534 | Verlängerung von Seq. ID No. 32 | 2x "DEAD" | 1245 | | |
| 535 | Verlängerung von Seq. ID No. 34 | | 822 | | |
| 536 | Verlängerung von Seq. ID No. 43 | | 2703 | 9q34.11–q34.13 | D9S179–D9S164 |
| 537 | Verlängerung von Seq. ID No. 44 | "MYB_3" | 2664 | 1q21.2 | D1S305–D1S506 |
| 538 | Verlängerung von Seq. ID No. 52 | | 3888 | | |
| 539 | Verlängerung von Seq. ID No. 54 | | 3304 | | |
| 540 | Verlängerung von Seq. ID No. 55 | | 863 | 3q24–q23 | D3S3409 |
| 541 | Verlängerung von Seq. ID No. 59 | | 1962 | 5q23.3–q31.1 | D5S396–D5S2119 |
| 542 | Verlängerung von Seq. ID No. 60 | 2x "PX"; "BEM_DOMAIN" | 1772 | 6q21 | AFMa191wd1 |
| 543 | Verlängerung von Seq. ID No. 65 | 2x "PDZ" | 1009 | 1q12 | D1S2669–D1S498 |
| 544 | Verlängerung von Seq. ID No. 69 | | 2834 | 1p21.3–p22.1 | D1S2166 |
| 545 | Verlängerung von Seq. ID No. 82 | | 2319 | 9q21.32–q22.1 | D9S264–D9S257 |
| 546 | Verlängerung von Seq. ID No. 84 | | 2456 | 17q23.1–q23.2 | D17S1680 |
| 547 | Verlängerung von Seq. ID No. 87 | | 2218 | 11p12–p13 | WI-6150 |
| 548 | Verlängerung von Seq. ID No. 88 | | 2196 | 1q42.11–q43 | WI-9317 |
| 549 | Verlängerung von Seq. ID No. 93 | | 701 | | |
| 550 | Verlängerung von Seq. ID No. 98 | | 2214 | 16p13.2–p12.3 | D16S499 |
| 551 | Verlängerung von Seq. ID No. 108 | | 1434 | | |
| 552 | Verlängerung von Seq. ID No. 111 | | 2434 | 6q21 | D6S278–D6S302 |
| 554 | Verlängerung von Seq. ID No. 114 | | 1457 | 7q32.3 | D7S686–D7S530 |
| 555 | Verlängerung von Seq. ID No. 126 | | 741 | | |

TABLE II

| DNA Sequences Seq. ID. No. DNA-Sequenzen Seq. ID. No. | Peptide Sequences (ORF's) Seq. ID. No. Peptid-Sequenzen (ORF's) Seq. ID. No. |
|---|---|
| 1 | 142 |
| | 143 |
| | 144 |
| 2 | 145 |
| | 146 |
| | 147 |
| 3 | 148 |
| | 149 |
| | 150 |
| 4 | 151 |
| | 152 |
| | 153 |
| 5 | 154 |
| | 155 |
| | 156 |
| 6 | 157 |
| | 158 |
| | 159 |
| 7 | 160 |
| | 161 |
| | 162 |
| 8 | 163 |
| | 164 |
| | 165 |
| 9 | 166 |
| | 167 |
| | 168 |
| 10 | 169 |
| | 170 |
| | 171 |
| 11 | 172 |
| | 173 |
| | 174 |
| 12 | 175 |
| 12 | 176 |
| | 177 |
| 13 | 178 |
| | 179 |
| 14 | 180 |
| | 181 |
| | 182 |
| 15 | 183 |
| | 184 |
| | 185 |
| | 186 |
| | 187 |
| 16 | 188 |
| | 189 |
| | 190 |
| 17 | 191 |
| | 192 |
| | 193 |
| 18 | 194 |
| | 195 |
| | 196 |
| 19 | 197 |
| | 198 |
| | 199 |
| 20 | 200 |
| | 201 |
| | 202 |
| 21 | 203 |
| | 204 |
| 22 | 205 |
| | 206 |
| 23 | 207 |
| | 208 |
| | 209 |
| | 210 |
| 24 | 211 |
| 24 | 212 |
| | 213 |
| 25 | 214 |
| | 215 |
| | 216 |
| 26 | 217 |
| | 218 |
| | 219 |

TABLE II-continued

| DNA Sequences Seq. ID. No. | Peptide Sequences (ORF's) Seq. ID. No. |
|---|---|
| 27 | 220 |
|  | 221 |
|  | 222 |
| 28 | 223 |
|  | 224 |
|  | 225 |
| 29 | 226 |
|  | 227 |
|  | 228 |
| 30 | 229 |
|  | 230 |
|  | 231 |
| 31 | 232 |
|  | 233 |
|  | 234 |
| 32 | 235 |
|  | 236 |
|  | 237 |
| 33 | 238 |
|  | 239 |
|  | 240 |
| 34 | 241 |
|  | 242 |
|  | 243 |
| 35 | 244 |
|  | 245 |
|  | 246 |
|  | 247 |
| 36 | 248 |
|  | 249 |
| 37 | 250 |
|  | 251 |
|  | 252 |
| 38 | 253 |
|  | 254 |
|  | 255 |
| 39 | 256 |
|  | 257 |
|  | 258 |
| 40 | 259 |
|  | 260 |
|  | 261 |
| 41 | 262 |
|  | 263 |
|  | 264 |
| 42 | 265 |
|  | 266 |
|  | 267 |
| 43 | 268 |
|  | 269 |
|  | 270 |
| 44 | 271 |
|  | 272 |
|  | 273 |
| 45 | 274 |
|  | 275 |
|  | 276 |
| 46 | 277 |
|  | 278 |
|  | 279 |
| 47 | 280 |
|  | 281 |
|  | 282 |
|  | 283 |
| 48 | 284 |
|  | 285 |
| 49 | 286 |
|  | 287 |
|  | 288 |
| 50 | 289 |
|  | 290 |
|  | 291 |
|  | 292 |
| 51 | 293 |
|  | 294 |
|  | 295 |
| 52 | 296 |
|  | 297 |
|  | 298 |
| 53 | 299 |
|  | 300 |
|  | 301 |
| 54 | 302 |
|  | 303 |
|  | 304 |
| 55 | 305 |
|  | 306 |
|  | 307 |
| 56 | 308 |
|  | 309 |
|  | 310 |
| 57 | 311 |
|  | 312 |
|  | 313 |
| 58 | 314 |
|  | 315 |
|  | 316 |
| 59 | 317 |
|  | 318 |
|  | 319 |
| 60 | 320 |
|  | 321 |
|  | 322 |
| 61 | 323 |
|  | 324 |
|  | 325 |
| 62 | 326 |
|  | 327 |
|  | 328 |
| 63 | 329 |
|  | 330 |
|  | 331 |
| 64 | 332 |
|  | 333 |
|  | 334 |
|  | 335 |
| 65 | 336 |
|  | 337 |
|  | 338 |
| 66 | 339 |
|  | 340 |
|  | 341 |
| 67 | 342 |
|  | 343 |
|  | 344 |
| 68 | 345 |
|  | 346 |
|  | 347 |
| 69 | 348 |
|  | 349 |
|  | 350 |
| 70 | 351 |
|  | 352 |
|  | 353 |
| 71 | 354 |
|  | 355 |
|  | 356 |
| 72 | 357 |
|  | 358 |
|  | 359 |
|  | 360 |
| 73 | 361 |
|  | 362 |
|  | 363 |
| 74 | 364 |
|  | 365 |
|  | 366 |
| 75 | 367 |

TABLE II-continued

| DNA Sequences Seq. ID. No. DNA-Sequenzen Seq. ID. No. | Peptide Sequences (ORF's) Seq. ID. No. Peptid-Sequenzen (ORF's) Seq. ID. No. |
|---|---|
|  | 368 |
|  | 369 |
| 76 | 370 |
|  | 371 |
|  | 372 |
| 77 | 373 |
|  | 374 |
|  | 375 |
| 78 | 376 |
|  | 377 |
|  | 378 |
| 79 | 379 |
|  | 380 |
|  | 380 |
|  | 381 |
| 80 | 382 |
|  | 383 |
|  | 384 |
| 81 | 385 |
|  | 386 |
|  | 387 |
| 82 | 388 |
|  | 389 |
|  | 390 |
| 83 | 391 |
|  | 392 |
|  | 393 |
| 84 | 394 |
|  | 395 |
| 85 | 396 |
|  | 397 |
|  | 398 |
| 86 | 399 |
|  | 400 |
|  | 401 |
|  | 402 |
| 87 | 403 |
|  | 404 |
|  | 405 |
|  | 406 |
| 88 | 407 |
|  | 408 |
|  | 409 |
| 89 | 410 |
|  | 411 |
|  | 412 |
| 90 | 413 |
|  | 414 |
|  | 415 |
| 91 | 416 |
|  | 417 |
|  | 418 |
| 92 | 419 |
|  | 420 |
|  | 421 |
|  | 422 |
| 93 | 423 |
|  | 424 |
|  | 425 |
|  | 426 |
| 94 | 427 |
|  | 428 |
| 95 | 429 |
|  | 430 |
|  | 431 |
|  | 432 |
| 96 | 433 |
|  | 434 |
|  | 435 |
| 97 | 436 |
|  | 437 |
|  | 438 |
| 98 | 439 |
|  | 440 |
|  | 441 |
| 99 | 442 |
|  | 443 |
|  | 444 |
| 100 | 445 |
|  | 446 |
|  | 447 |
| 101 | 448 |
|  | 449 |
|  | 450 |
| 102 | 451 |
|  | 452 |
|  | 453 |
| 103 | 454 |
|  | 455 |
|  | 456 |
| 104 | 457 |
|  | 458 |
|  | 459 |
|  | 460 |
| 105 | 461 |
|  | 462 |
|  | 463 |
| 106 | 464 |
|  | 465 |
| 107 | 466 |
|  | 467 |
|  | 468 |
|  | 469 |
| 108 | 470 |
|  | 471 |
|  | 472 |
| 109 | 473 |
|  | 474 |
|  | 475 |
| 110 | 476 |
|  | 477 |
|  | 478 |
| 111 | 479 |
|  | 480 |
|  | 481 |
| 112 | 482 |
|  | 483 |
|  | 484 |
|  | 485 |
| 113 | 486 |
|  | 487 |
|  | 488 |
| 114 | 489 |
|  | 490 |
|  | 491 |
| 115 | 492 |
|  | 493 |
|  | 494 |
|  | 495 |
| 116 | 496 |
|  | 497 |
|  | 498 |
| 117 | 499 |
|  | 500 |
|  | 501 |
| 118 | 502 |
|  | 503 |
|  | 504 |
| 119 | 505 |
|  | 506 |
|  | 507 |
| 120 | 508 |
|  | 509 |
|  | 510 |
| 121 | 511 |
|  | 512 |
|  | 513 |
| 122 | 514 |

TABLE II-continued

| DNA Sequences Seq. ID. No. DNA-Sequenzen Seq. ID. No. | Peptide Sequences (ORF's) Seq. ID. No. Peptid-Sequenzen (ORF's) Seq. ID. No. |
|---|---|
|  | 515 |
|  | 516 |
| 123 | 517 |
|  | 518 |
|  | 519 |
| 124 | 520 |
|  | 521 |
|  | 522 |
| 125 | 523 |
|  | 524 |
|  | 525 |
| 126 | 526 |
|  | 527 |
|  | 528 |
| 531 | 561 |
|  | 562 |
|  | 563 |
| 532 | 564 |
|  | 565 |
|  | 566 |
| 533 | 567 |
|  | 568 |
|  | 569 |
| 534 | 570 |
|  | 571 |
|  | 572 |
| 535 | 573 |
|  | 574 |
|  | 575 |
| 536 | 577 |
|  | 578 |
| 537 | 579 |
|  | 580 |
|  | 581 |
| 538 | 582 |
|  | 583 |
|  | 584 |
| 539 | 585 |
|  | 586 |
|  | 587 |
| 540 | 588 |
|  | 589 |
|  | 590 |
| 541 | 591 |
|  | 592 |
|  | 593 |
| 542 | 594 |
|  | 595 |
|  | 596 |
| 543 | 597 |
|  | 598 |
|  | 599 |
| 544 | 600 |
|  | 601 |
|  | 602 |
| 545 | 603 |
|  | 604 |
|  | 605 |
| 546 | 606 |
|  | 607 |
|  | 608 |
| 547 | 609 |
|  | 610 |
|  | 611 |
| 548 | 612 |
|  | 613 |
|  | 614 |
| 549 | 615 |
|  | 616 |
|  | 617 |
| 550 | 618 |
|  | 619 |
|  | 620 |
| 551 | 621 |
|  | 622 |
|  | 623 |
| 552 | 624 |
|  | 625 |
| 554 | 630 |
|  | 631 |
|  | 632 |
| 555 | 633 |
|  | 634 |
|  | 635 |

The inventive nucleic acid sequences Seq. ID No. 1 to Seq. ID No. 141 of the determined candidate genes and the determined amino acid sequences Seq. ID Nos. 142–528 are described in the following sequence protocol.

SEQUENCE LISTING (637 sequences)

SEQ ID NO: 1 - DNA, 1046 bp, Homo sapiens
tcggaacgagggatcactaatcaacaaaccagctttcggggtctgacgcgatccttgcctcaggcctctcgaggtccagacagccgcccagcccgctctgcgacgcagcagtgaatagtgtggtacctccttgtctcggttcaggtccagacctccccgtcttccggctgccctgaacgtcaggcgacctcaggaccctgtgattggcgcctgcgccggcggaccgtgaccgaggaaacccctggagggacttgggcattccttgggctccgtgcctgttcttcgtgctcctttcggggcaaggatctcacattatcagtctttgaccgacacagaatgcctggcatttgataaatgtttgttgaacttgaagagacatatggacaatgaatctgcaaagatactggggagagataccaatatcatcaagccagaccaacagaagttccttcgatttgctcccacgggagttccgtctggtggaagtccatgacccacccctgcaccaaccctcagccaacaagccgaagccccccactatgctggacatcccctcagagccatgtagtctcaccatccatacgattcagttgattcagcacaaccgacgtcttcgcaaccttattgccacagctcaggcccagaatcagcagcagacagaaggtgtaaaaactgaagagagtgaacctcttccctcgtgccctgggtcacctcctctccctgatgacctcctgcctttagattgtaagaatcccaatgcaccattccagatccggcacagtgacccagagagtgacttttatcgtgggaaaggggaacctgtgactgaactcagctggcactcctgtcggcagctcctctaccaaggcagtggcacaaatcctggccaacggcgggcttttgactgtgctaatgagagtgtcctggaagaccctaacttgatgttggcacatgagtattggccttaaagtttaccaaagtttgctgcgtttttgctgttgagcgggaagcccgggtgggagagacttccttttgccgaatgtgat

SEQ ID NO: 2 - DNA, 373 bp, Homo sapiens
cgaaggcagagttcaacagggatcttttgtaaatgttcaacaagggccacaggagccatttattgaatttatccatcagttaacccaggcaattaagagcacacatggaacatcgaccattccacgggtatctcgtataaccctcaaggacaagccatagtggaacgttgcccattccacgcttaaaaatatgctttaaaaaaagggggaatatgaataaggaccctacaacactactagcacaagtgttattcacccttaatttcttaaatttagataattaaatttccaatcagccctagaaaagcacttttgcttaaaacctccccaggtagcaaggctttcagtgttttgggaaggtgttaatagtatc

SEQ ID NO: 3 - DNA, 1571 bp, Homo sapiens
ctgctctggcaaccaatagaagctaggagagggcggggacaactgggtcttttgcggctgcagcgggcttgtaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagaccaccaccatcaaggtcatcattgtcatctacctgtccgtggtgggtgccctgttgctctacatggccttcctgatgctggtggaccctctgatccgaaagccggatgcatacactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctccgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttctttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctccaaaaaaaaaaaaaaaaaa

SEQ ID NO: 4 - DNA, 1789 bp, Homo sapiens
agaccatgctggaaaaaattccaaaggaagagcaagaagagacgtctgcaattcgagtgggttttatcacatataacaaagttctccatttctttaatgtgaagagtaatctggcccagcctcagatgatgggggtgactgatgttggagaagtctttgttcctttgttggatggtttccttgtcaactatcaagaatcccaatctgtgattcataatttgttggaccagattccagacatgtttgcagactctaatgaaaatgagactgtctttgctcctgtcatccaggctggcatggaagcactaaaggcagcagactgtcctgggaagctgttcatcttccattcttccttgccaactgctgaagcaccagggaagctcaaaaacagagatgacaaaaaactggttaatacagacaaagagaagatacttttccagccccaaacaaatgtctatgactcattggccaaggactgcgtggctcaccggctgctctgtgacactcttcctctttcctagtcagtatgtggacgtggcctcgctggggctggttcctcagctcactggaggaaccctttacaaatacaacaatttccagatgcacttggatagacaacaatttttgaacgacctcagaaatgatattgaaaagaaaataggctttgatgctattatgagggttcgtaccagcacaggtttcagagccactgatttctttggtggaatcttgatgaacaacaccaccgatgtagaaatggctgccatcgattgtgacaaggcagtgaccgtggagttcaagcacgatgacaaactcagtgaagacagtggagccttaatccagtgtgctgtgctttacacgacaatcagtggtcaaagaagacttcggattcacaatcttggcttaaactgcagctctcagctagctgatctttataagagctgtgagacagatgctcttatcaacttctttgccaagtcagcttttaaagcagttctccaccagcctttgaaggtcatccgggaaattctagttaatcagactgcccatatgttggcatgttaccggaagaattgtgcaagtccttctgcagcaagccagcttattctaccagattccatgaaagtattgccagtgtacatgaattgcttgttgaaaaactgtgtactactcagcagaccagagatctcaactgatgaacgagcataccagagacagctggtcatgaccatgggtgtggctgactctcagcttttcttctacccacaacttctgcccatacacacgttagatgtcaagagtacaatgttacctgctgccgttcgttgctctgagtcccgtctttcagaagaaggaatattcttactggctaatggtctacacatgttcctgtggttgggagtaagcagcccaccagaactgatccaaggaatatttaatgtgccatcttttgcacatatcaacacagatatgacattgctgcctgaagtgggaaacccatactctcaacaactcagaatgataatgggtattatccaacaaaagaggccatattcaatgaagctcacaattgtaaagcagcgagaacaaccagaaatggttttccgacagttcctggtagaagacaaaggactttacggaggctcttcttatgtggatttcctttgttgtgttcacaaggagatctgtcagctgcttaattaattggaaactccccgggcaatggaggttgcgttgccagggggggaaaagcccctttttggggcccaaatttgccagggggaaaaag

SEQ ID NO: 5 - DNA, 2361 bp, Homo sapiens
gggccagccggctcgcccgggggccatggcagcagcggctactgcagccgagggggtccccagtcgggggcctcccggggaagtcatccatctgaatgtgggaggcaagagattcagtacctctcgccagactctcacctggatcccagactccttcttctccagtcttctgagcggacgcatctcgacgctgaaagatgagaccggagcaatcttcatcgacagggaccctacagtcttcgcccccatcctcaacttcctgcgcaccaaagagttggatcccaggggtgtccacggttccagcctcctccatgaagcccagttctatgggctcactcctctggttcgtcgcctgcagcttcgagaggagttggatcgatcttcttgtggaaacgtcctcttcaatggttacctgccgccaccagtgttcccagtgaagcggcggaaccggcacagcctagtggggcctcagcagctaggaggacggccagcccctgtccgacggagcaacacgatgccccccaaccttggcaatgcagggctgctgggccgaatgctggatgagaaaacccctccctcaccctcaggacaacctgaggagccggggatggtgcgcctggtgtgtggacaccataattggatcgctgtggcctatacccagtttctagtctgctacaggttgaaggaagcctctggcgggcagctggtgttttccagcccccgcctggactggcccatgcgaacgactggcgcttcacagcccgggtgcatggtggggctttgggtgaacatgacaagatggtggcagcagccaccggcagcgagatcctgctatgggctctgcaggcggaaggcggtggctccgagataggggtctttcatctgggggtgcctgtggaggccttgttcttcgtcgggaaccagctcattgctacaagccacacagggcgcatcggggtgtggaatgccgtcaccaagcactggcaggtccaggaggtgcagcccatcaccagttatgacgcggcaggctccttcctcctcctgggctgcaacaacggctccatttactacgtggatgtgcagaagttccccttgcgcatgaaagacaacgacctccttgtcagcgagctctatcgggacccagcggaggatggggtcaccgccctcagtgtctacctcacccccaagaccagtgacagtgggaactggatcgagatcgcctatggcaccagctcagggggcgtgcgggtcatcgtgcagcacccggagactgtgggctcggggcctcagctcttccagaccttcactgtgcaccgcagccctgtcaccaagatcatgctgtcggagaagcacctcatctcagtctgtgccgacaacaaccacgtgcggacatggtctgtgactcgcttccgcggcatgatttccacccagcccggctccaccccactcgcttcctttaagatcctggctctggagtcggcagatgggcatggcggctgcagtgctggcaatgacattggcccctacggtgagcgggacgaccagcaagtgttcatccagaaggtggtgcccagtgccagccagctcttcgtgcgtctctcatctactgggcagcgggtgtgctccgtgcgctccgtggacggctcacccacgacagccttcacagtgctggagtgcgagggctcccggcggctcggctctcggccccggcgctacctgctcactggccaggccaacggcagcttggccatgtgggacctaaccaccgccatggacggcctcggccaggcccctgcaggtggcctgacggagcaagagctgatggaacagctggaacactgtgagctggccccgccggctccttcagctccctcatggggctgtctccccagcccctcaccccgcatctccctcaccagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtcaccctccccaataaagtcctcactgccaaaaaaaaaaaaaaaaaaaccg

SEQ ID NO: 6 - DNA, 1638 bp, Homo sapiens
ggctgcggatttcgccggaaatcccggaagtgacagctttgggggtttgctgctggctctgactcccgtcctgcgatgggttgcgacgggggaacaatccccaagaggcatgaactggtgaaggggccgaagaaggttgagaaggtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcgtgctcaatggcaccaaggaggatgtggacgtgctgaagacaaggatggaggagagaaggctgagagcgaattggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccggtgattgggttcaaaaataaagctggtctgcctcttcaaaaaaaaaaaaaaaaaaaaaaaaaa

SEQ ID NO: 7 - DNA, 1034 bp, Homo sapiens
cgcctgcgcgctgagtgcgtgccgctccgccgaccgaagaggctggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctgggacctacccccacgtgggtgttaaggcagagggaaggaattggttcactttaacttcccaggcaaacattcctcctggccacttagggagggaaacaccttccctatgggttaccatttgttgtttgttcaggaaccaggcggattcagttgcctaggcgtgttgccccagcaattagtttgggcattgca

SEQ ID NO: 8 - DNA, 947 bp, Homo sapiens
cgaggccctggcatgtgcaaagagtactgagtgggattcccagcaggataccatcaagtactacaccatgcacctgaccacattgtgcaacacgtgattggacaacccaacccagagaaacaaggatcagctgatccgggcagccgtgaagtttctggacaccgacaccatctgctacagggtggaggagcccgagacattagtggaacttcaaaggaatgagtgggatccaatcatcgaatgggctgagaaaagatacggcgtggagatcagctcctccaccagcataatgggacccagcatccctgccaaaactcgggaggtgctcgtcagccacctggcatcttacaacacatgggctttacaagggattgagtttgtagctgcccagctcaagtccatggtgctaaccttgggcctgattgacctgcgcctgacagtggagcaggccgtgctgctgtcacgcctggaggaggagtaccagatccagaagtggggcaacattgagtgggcccatgactatgagctgcaggagctgcgggcccgcaccgccgccggcaccctcttcatccatctctgctccgagagcaccacagtcaagcacaagctcctgaaggagtgaggcctgggcagagcacactcagcaggatagaggcagtgcagccacagctcccccggccttcagggctccccagcctgtggggctggcttccttggcttttggggactcggcctcagcgtcaccctgagattccccccgagacacagtgcgctagtacggctgtccggaggtcagcctgatttcaacccaggtgcccctggcctggccagcagtgaatgtaggagatgaattgtgcaagtgactttctctcgactctgattttattaaatatttctccaccctggaaaaaaaaaaaaaaaaaaaaaaaaaaaaaaaaaaaaaaaaa

SEQ ID NO: 9 - DNA, 497 bp, Homo sapiens
ctcgtggcgagagactgagataaaagagcaactcactgaacacctttgtacgatcatacagcaaaatgagctccgaaaggccaagaagttggaggagttgatgcaacaactagatgtagaagccgatgaagagactttggagcttgaggtggaggtcgagagattgctacacgaacaagaagtagaatcaaggagaccagtggttcgtttagagaggccatttcagcctgcggaggagagtgtgacattagaatttgctaaagagaacagaaagtgtcaagaacaagctgtttccccaaaggtagatgaccagtgtggaaattccagtagcatcccctttcttagtccaaactgcccaaatcaagaaggtaatgacatttcagctgctttggccacatgaagttctggtattcttttgagctaatatggtattgagtaaagtatactttttgcagtagatcatgccctgacctccaataaaaacctctttaaaacaa

SEQ ID NO: 10 - DNA, 269 bp, Homo sapiens
cggggagaggtgggctgggctgcaggtcctggcgttgtgctggatcatcgcgcccgtactctgaagttttctccgtggcgctccttgagaggggttcctcctgcatcttgagaatattttgcatttcggctcccttctcttctcgctgccatcggatgccccaaataggtcctgtcccctcggtgaatcagacttcggaaaccgcctcgcttcagggtcagagtccaagtacagatgagcttgagagggattctgaaatgcaacggccc

SEQ ID NO: 11 - DNA, 1717 bp, Homo sapiens
attctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggcgtggcctcctactgccgtccctgtgccctagaagcctctgatgtgggctcctcctgcacctcttgtcctgctggttactatattgaccgagattcaggaacctgccactcctgcccccctaacacaattctgaaagcccaccagccttatggtgtccaggcctgtgtgccctgtggtccagggaccaagaacaacaagatccactctctgtgctacaatgattgcaccttctcacgcaacactccaaccaggactttcaactacaacttctccgctttggcaaacaccgtcactcttgctggagggccaagcttcacttccaaagggttgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcagatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaaggactgtgacctgccagcagctgacagctgcgccatcatggaaggcgaggatgtagaggacgacctcatctttaccagcaagaagtcactctttgggaagatcaaatcatttacctccaagaggactcctgatggatttgactcagtgccgctgaagacatcctcaggaggcccagacatggacctgtgagaggcactgcctgcctcacctgcctcctcaccttgcatagcacctttgcaagcctgcggcgatttgggtgccagcatcctgcaacacccactgctggaaatctcttcattgtggccttatcagatgtttgaatttcagatctttttttatagagtacccaaaccctcctttctgcttgcctcaaacctgccaaatatacccacactttgtttgtaaattaaaaaaaa

SEQ ID NO: 12 - DNA, 1419 bp, Homo sapiens
ggcagaggtattacctgaaaacttaaaagaaggcctgaaggaatcttcctggagttcattaccatgtactaaaaacagaccttttgattttcattcagtgatggaagagtctcagtctctcaatgaacctagcccaaagcagagtgaagaaataccagaggtcacttcagagcctgtcaaaggaagcttaaaccgtgctcagtcagcacagtctataaattcaacagaaatgcctgccagagaggactgtttgaaaaaagagtgccctcagaacctgttctgtcagttcaagaaaaaggtgttctgctgaaaagaaagttgtctcttttagaacaggatgtgattgtaaatgaagatggaagaaataagctgaaaaaacaaggagaaactcccaatgaagtctgtatgttttccttagcttatggtgatattccagaagaattaatcgatgtctcagatttcgagtgttctctctgcatgaggttgttttttgagccagtaacaaccccttgcggacattcgttctgtaagaattgtcttgagcgttgtttagatcatgcaccatattgtcctctttgcaaagaaagcttaaaagagtatctagcagataggaggtactgtgtcacacagctgttggaaggaattaatagtgaagtatctgcctgatgaactgtctgagagaaaaaaaatatatgatgaagaaactgctgaactctcacacttgaccaagaatgttccaatatttgtttgcactatggcctaccccactgtgccttgccctctccatgtatttgagccaagatacagattgatgattcgaagaagtatacagactggaaccaaacagtttggcatgtgtgtcagtgatacacaaaatagttttgcagattatggttgtatgttacaaattagaaacgtgcatttcttaccggacggaaggtctgtggttgatacagttggaggaaagcggtttagggttttaaaaagaggaatgaaagatggatattgcactgccgacattgaatatctggaagatgttaaggttgagaatgaagatgagattaagaatctcagagagcttcatgatttggtttactctcaagcctgcagctggtttcagaatttaagagacagatttcgaagccaaattcttcagcatttcggatcaatgcccgagaggagggaaaaccttcaggcagcccctaatggacctgcatggtgttggtggcttcttgcagttctccctgtagacccacgataccagctgtcggttttgtcaatgaagtctttgaaagaacggttgaccaagatacagcatatactgacctatttttctagagaccaattctaagtaactaactctttgggatcttccctttgaaagttgacccctaattcttgggctgccatttggttggg

SEQ ID NO: 13 - DNA, 671 bp, Homo sapiens
agcgcggtgaagcgggggtgggatctgaacatggcggcggtggtagctgctacggcgctgaagggccggggggcgagaaatgcccgcgtcctccgggggattctcgcaggagccacagctaacaaggcttctcataacaggacccgggccctgcaaagccacagctccccagagggcaaggaggaacctgaacccctatccccggagctggaatacattcccagaaagaggggcaagaaccccatgaaagctgtgggactggcctgggccatcggcttcccttgtggtatcctcctcttcatcctcaccaagcgggaagtggacaaggaccgtgtgaagcagatgaaggctcggcagaacatgcggttgtccaacacgggcgagtatgagagccagaggttcagggcttcctcccagagtgccccgtcccctgatgttgggtctggggtgcagacctgaggagcgctgcgaccctcctaggctattgactgttaagtcctcaggtttggcccagattccagttcgtgcctctgaggtccaccagagggcgcatgaagcccaggctgttgccaaaccctaccctgccccacaccaaggagcccaccaaaggcaaataaagttattgagtgtttagtagaaaggaaaaaaaaaaaaaaaaaaaaaagtcgacc

SEQ ID NO: 14 - DNA, 524 bp, Homo sapiens
aagtgttctcagatgctgatgtttgtaaggtcccggtggggccatgaggaagaagaggagctgaaggtaagagactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaatgtccaaaaggtgaattctcatttcattcaaacaaagacagatttgcgcattcactcaagcagaatgtggccatgaatattcagcccctgcatacatacaaagatgtacgcatgattccccccaccaagcacacacacagtcacacacgcacacacacacacatgcacacacgcgcgtgcacacacggacacatgcacacacacacgcacacgtaaacacatgcacacatgcacacacgtgcacacatgcacacacggacacactt

SEQ ID NO: 15 - DNA, 345 bp, Homo sapiens
aaactttctttctacaaaaaatcaaaagcttagctgatagatcatgaaaatagattatgaacagtgaaattcctgagaaggctgaaagtgcggggaaccaaagcaggggagattagccttagtccggaggagggagaagcagatggaagtcagcagcctgccttgtttttacgtgtaatatttaaatttgcaaattgtattacaggagggcctactttctgtttttatcaagagtttttcttttgttcaaagacactggttatgggaatattttgaaagggtaagaaacgctggtataaaaaggtgttgcagattaattttgaaggtccttacggaaccagtccc

SEQ ID NO: 16 - DNA, 1060 bp, Homo sapiens
ggcggtcccaggcaggcccagaagctgggcagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaaaaaaaaaaaaa

SEQ ID NO: 17 - DNA, 1721 bp, Homo sapiens
ctctctctctttctgtctcttcctcgctccctctctttctctcctccctctgccttcccagtgcataaagtctctgtcgctcccggaacttgttggcaatgcctattttttggctttcccccgcgttctctaaactaactatttaaaggtctgcggtcgcaaatggtttgactaaacgtaggatgggacttaagttgaacggcagatatatttcactgatcctcgcggtgcaaatagcgtatctggtgcaggccgtgagagcagcgggcaagtgcgatgcggtcttcaagggcttttcggactgtttgctcaagctgggcgacacatggccaactacccgcaggcctggacgacaagacgaacatcaagaccgtgtgcacatactgggaggatttccacagctgcacggtcacagcccttacggattgccaggaaggggcgaaagatatgtgggataaactgagaaaagaatccaaaaacctcaacatccaaggcagcttattcgaactctgcggcagcggcaacggggcggcggggtccctgctcccggcgttcccggtgctcctggtgtctctctcggcagctttagcgacctggctttccttctgagcgtggggccagctccccccgcgcgcccacccacactcactccatgctcccggaaatcgagaggaagatccattagttctttggggacgttgtgattctctgtgatgctgaaaacactcatataggattgtgggaaatcctgattctcttttttatttcgtttgatttcttgtgttttatttgccaaatgttaccaatcagtgagcaagcaagcacagccaaaatcggacctcagctttagtccgtcttcacacacaaataagaaaacggcaaacccaccccattttttaattttattattattaattttttttgttggcaaaagaatctcaggaacggccctgggccacctactatattaatcatgctagtaacatgaaaaatgatgggctcctcctaataggaaggcgaggagaggagaaggccaggggaatgaattcaagagagatgtccacggacgaaacatacggtgaataattcacgctcacgtcgttcttccacagtatcttgttttgatcatttccactgcacatttctcctcaagaaaagcgaaaggacagactgttggctttgtgtttggaggataggagggagagagggaaggggctgaggaaatctctggggtaagagtaaaggcttccagaagacatgctgctatggtcactgaggggttagctttatctgctgttgttgatgcatccgtccaagttcactgcctttattttccctcctccctcttgttttagctgttacacacacagtaatacctgaatatccaacggtatagatcacaagggggggatgttaaatgttaatctaaaatatagctaaaaaaagattttgacataaaagagccttgattttaaaaaaaaaagagagagagatgtaatttaaaaagtttattataaattaaattcagcaaaaaaagatttgctacaaagtatagagaagtataaaataaaagttattgtttgaaaaaaaagtgtcgtttgtttcctaccccaacctgctttcttgacccagttctcagggaacctgaagggacacaggatgccggtgataagctcacctcttcaggaagccgcttcaagcagacctgccaccttcaagca

SEQ ID NO: 18 - DNA, 2367 bp, Homo sapiens
accctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattaccattaaaaaaaaaaaaaaaaaaaaaaaaaaaaaaaaaa

SEQ ID NO: 19 - DNA, 1321 bp, Homo sapiens
cctggaaacaagatccaaacccaagtgaccccgccggaaagtgacccagtcaggtttaaaaattccaacaaaccgacgtgaacaaatagaccgaccaaccaaatatacaatccgtcaaaatacattcacttccactacgaaaccccaacaaagggtgtgaatgcccgcccaggagagacggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcctaagagttcaggcggactggcagggtcaggcgcctgtagatgttttgg

SEQ ID NO: 20 - DNA, 384 bp, Homo sapiens
ggtcgaatccaaatcactcattgtgaaagctgagctcacagccgaataagccaccatgaggctgtcagtgtgtctcctgatggtctcgctggccctttgctgctaccaggcccatgctcttgtctgcccagctgttgcttctgagatcacagtcttcttattcttaagtgacgctgcggtaaacctccaagttgccaaacttaatccacctccagaagctcttgcagccaagttggaagtgaagcactgcaccgatcagatatcttttaagaaacggcttctcatttgaaaaagtcctgggtgggaatagtgaaaaaatgtgggtgtgtgacatgtaaaaatgctcaacctgggtttccaaagtcttttcaacggcaacctgat

SEQ ID NO: 21 - DNA, 367 bp, Homo sapiens
gggcactggtggtccggttcctcaccaaacgattcatcggtgactatgaaagaaatgcaggtaatctctatactagacaagttcagatagaaggtgaaaccctggctcttcaggttcaagacactccaggtattcaggtccatgagaacagcctgagctgcagtgaacagctgaataggtgcattcgctgggcagatgctgtggtgatcgttttctccatcactgactacaagagctatgaactcatcagccagctccaccagcacgtgcagcagctacaccttgggcacccggctgcctgtgggtggtcgtgggccaacaaaagtgacctgttgcacatcaaacaggttgaccctcagcttggact

SEQ ID NO: 22 - DNA, 2621 bp, Homo sapiens
gggcctttgcccgccttggcggccggctctacgttccctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcgtttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcattgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcacatatcactgtaaggtacagttagggtaacactttagaggtttattatttttaaaaaacttttcttgaactcctggccaacatggtgaaaccccgtctctactaaaaataccaaaattagccaggcgtgatggtgggtgcctgtaatctcagctacttgggaggctgaagcaggagaactgcctgaacccaggaggcagaggttgcagtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaacaaaaagtgtccactattggtgaccgaggtggggccgtttttttgaaattgggggggaaatttgcccgtgggtgggagggcctttgtggggggggaaaaattgcccccttgg

SEQ ID NO: 23 - DNA, 2019 bp, Homo sapiens
ctgtatcctaatttcttggtgaatgaactcattcttaaacagaagcaaagatttgaggaaaagaggttcaaattggaccactcagtgagtagcaccaatggccacaggtggcagatatttcaagattggttgggaactgaccaagataaccttgatttggccaatgtcaatcttatgttggagttactagtgcagaagaagaaacaactggaagcagaatcacatgcagcccaactacagattcttatggaattcctcaaggttgcaagaagaaataagagagagcaactggaacagatccagaaggagctaagtgttttggaagaggatattaagagagtggaagaaatgagtggcttatactctcctgtcagtgaggatagcacagtgcctcaatttgaagctccttctccatcacacagtagtattattgattccacagaatacagccaacctccaggtttcagtggcagttctcagacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatgaagggttaactcaagtcaaattgtacttgatcctgctgaaatacatctgcagctgacaatgagagaagaaacagaaaatgtcatgtgatgtctctccccaaagtcatcatgggttttggatttgttttgaatatttttttctttttttcttttccctcctttatgacctttgggacattgggaatacccagccaactctccaccatcaatgtaactccatggacattgctgctcttggtggtgttatctaatttttgtgatagggaaacaaattcttttgaataaaaataaataacaaaacaataaaagtttattgagccacaaaaaaaaaaaaaaaaaaaaaaaaagaaaagaagggaggagggaaagg

SEQ ID NO: 24 - DNA, 1866 bp, Homo sapiens
gtggttgctgtgacaggcactatttgaagtgctttatcatggattaactcttaatcctcagctaccgtataaagtaggacataaccccatttcacatgcactacactgagacttgcctcctctccccccacattgaagatgttcttttttcataactatatactattccattgcatgaatattctgtaatttatttaatcccctatggattgataattaggttcattatagatagaagtgtaattaacattcctgtacatgtattttgctacttgtgtgggtatttctgtaggatgaataactagaaatttattggatcaggtttcacatttgcagttttgaaaactactaccaaaaagatttcaccaatttacaactccatcattagtaagaatgcctgtttgcctatagtctgccaaccctgaatccttaaaaatttttgccaatctggtaggcaaaatttctttcttttctttgaatattaatgaggaggaacatcttttcatgtttcttggccatttgcatttcctattatgaattgcttttgcccattttcctttttttaattatgaaagtctaatgactaccttctcattgtataaaaaacacagttctttgaatagagagacccttttctccaatgctaccaatcacattccacttaccacagtttaacatacatcctctagtcacctttccgtacgaatatacatacacataaaaacactttttacataaataggatctcatattctgtagctttttaaaattttggtctcaaaaaaagataacaggtctttaaatttctttaatggttgaatatgattaaatactatgaaaatgccattatttattcccttaatttttttcctctcgctattacattgccaaagtaaacatcctattcagatgtctttgtgcatgtgtgtgaatatttctttagtctggagtccagtaaggtggatttttggatcaaagggtttgttctctgtccaccttcagtcttcccaaaggccttcataactgtattttcaccaagtgtatggagaatgttcatttccccatataaccatacctacacttgatagtttttatctgttgggcgaaaaagaaccttttcttattttgcatttccctgattataaaaaaaaatggtgagattggggttattttcatgtttattggccatttatagtttactgtggattgtttgtatcccttacctgctttctattgggttatgtgtggatatattgtttttatttgttcagcatctccttccccatcttctggtaacacaacctttatttatttgtggggaacctattccctgtggcttaggtgagcatgtgaccaggcctggcctcctgagtcccacagcttcctagccacagtgataaaagaatgggtatataacttaagccaggctaaggaaagcccttaacagaacttctgctggaactactggaaagaaggctttatggagatcccaggaaccaaggaccatgtaagcctgaatttgtgccatgtggagagagtctgtctgaggagaaactcggatgctagcagaaatggaaagagaactaagttctgatgtcatttttctggaggccctagatccagctgtgcctaaagcctgccctacctccggactttaaagttttgtgagccaataaagtccctttcttgtttaagataattgaattgagtttctgttctgattaatataggttatttgtattttcttattgatttgtagaaaacctttgtaattttaaattctagactttatgcactatataagttaataaaattagcatggccttccatgaaaaaaaaaaaaaaaaaaaaaaaaaaaaaaaaaaa

SEQ ID NO: 25 - DNA, 1189 bp, Homo sapiens
ctagcaagcaggtaaacgagctttgtacaaacacacacagaccaacacatccggggatggctgtgtgttgctagagcagaggctgattaaacactcagtgtgttggctctctgtgccactcctggaaaataatgaattgggtaaggaacagttaataagaaaatgtgccttgctaactgtgcacattacaacaaagagctggcagctcctgaaggaaaagggcttgtgccgctgccgttcaaacttgtcagtcaactcatgccagcagcctcagcgtctgcctccccagcacaccctcattacatgtgtctgtctggcctgatctgtgcatctgctcggagacgctcctgacaagtcgggaatttctctatttctccactggtgcaaagagcggatttctccctgcttctcttctgtcacccccgctcctctcccccaggaggctccttgatttatggtagctttggacttgcttccccgtctgactgtccttgacttctagaatggaagaagctgagctggtgaagggaagactccaggccatcacagataaaagaaaaatacaggaagaaatctcacagaagcgtctgaaaatagaggaagacaaactaaagcaccagcatttgaagaaaaaggccttgagggagaaatggcttctagatggaatcagcagcggaaaagaacaggaagagatgaagaagcaaaatcaacaagaccagcaccagatccaggttctagaacaaagtatcctcaggcttgagaaagagatccaagatcttgaaaaagctgaactgcaaatctcaacgaaggaagaggccattttaaagaaactaaagtcaattgagcggacaacagaagacattataagatctgtgaaagtggaaagagaagaaagagcagaagagtcaattgaggacatctatgctaatatccctgaccttccaaagtcctacataccttctaggttaaggaaggagataaatgaggaaaaagaagatgatgaacaaaataggaaagctttatatgccatggaaattaaagttgaaaaagacttgaggactggagaaagtacagttctgtcttcaatacctctgccatcagatgactttaaaaggtccaggagtaaaagtttatgatgatgggcaaaagtccagtgtattcagtaaagtgctaatcacaagttggaggt

SEQ ID NO: 26 - DNA, 1418 bp, Homo sapiens
gagctcgcagctccgccggcgcctggtcccagcgcccgcggcgccgcgtccccggcccaaccatggcgtcctccgcggccggctgcgtggtgatcgttggcagtggagtcattgggcgaagtgggccatgctgtttgccagtggaggcttccaggtgaaactctatgacattgagcaacagcagataaggaacgccctggaaaacatcagaaaggagatgaagttgctggagcaggcaggttctctgaaaggctccctgagtgtggaagagcagctgtcactcatcagtggttgtcccaatatccaagaagcagtagagggtgccatgcacattcaggaatgtgttccagaagatctagaactgaagaagaagatttttgctcagttagattccatcattgatgatcgagtgatcttaagcagttccacttcttgtctcatgccttccaagttgtttgctggcttggtccatgtgaagcaatgcatcgtggctcatcctgtgaatccgccatactacatcccgctggttgagctggtcccccacccggagacggcccctacgacagtggacagaacccacgccctgatgaagaagattggacagtgccccatgcgagtccagaaggaggtggccggcttcgttctgaaccgcctgcaatatgcaatcatcagcgaggcctggcggctagtggaggaaggaatcgtgtctcctagtgacctggaccttgtcatgtcagaagggttgggcatgcggtatgcattcattggacccctggaaaccatgcatctcaatgcagaaggtatgttaagctactgcgacagatacagcgaaggcataaaacatgtcctacagacttttggacccattccagagttttccagggccactgctgagaaggttaaccaggacatgtgcatgaaggtccctgatgacccggagcacttagctgccaggaggcagtggagggacgagtgcctcatgagactcgccaagttgaagagtcaagtgcagccccagtgaatttcttgtaatgcagcttccactcctctcattggaggccctatttgggaacactgcaagcccttaatcagccctctgtgacataggtagcagcccacggagatcctaagctggctgtcttgtgtgcagcctgagtggggtggtgcaggccggtagtctgcccgtcactttggatcatagccctgggcctggcggcacagcagcacttgcgttctcggggctgtcgatttcctgccacctgggcagataacctggagattttcaccttttctttttcagcttgattgcatttgagtatgatttgacagccagtgattgtagttttcatgttaatatgtgggcaaaatatttttgtaattatttttgtaatccctttctgagtaatctgggggtcctt

SEQ ID NO: 27 - DNA, 814 bp, Homo sapiens
gcagcaacggggtgcggcagggtggggaacgcgggagggggccagctcccaggaaagctggtctgcgagcggcccctgcccggctcccaggtccctgcgcgaccccgcccttcccgagaccccagccgggctgccgcccgcgtcccggaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacagtcttctcaacccttgcctgcagagaagttcctctgctagtctcatcttttccaggcaccccaaggcacttgcctcctcctcctttctttccctgaaatggaagaagcatttctgagagggctctcccttctctctctgcttttcctctgacttcatgagacccccaccacacctttcctacccctactctggctacaggtaaaaatccaggggcagaacaaggagatgttggcggccgcctgtcagatgttgctggggaagacggaggctgagattgcccacattgccctggagacgttagagggccaccagagggccatcatggcccacatgacttgtgggagggttgggcttaga

SEQ ID NO: 28 - DNA, 3039 bp, Homo sapiens
gaactgagatattgtaatcaaatagttaacatcaggaagttaatttggctggcaaaattctagggaaacttggccagaaaactggtgttgaaggcttttgctcatataaacaagtgccattgagtttcaaatgaccagcaaatatatttagaacccttcctgttttatgtctgtacctcgtccacccctcaggtaatacctgcctctcacaggtacagctgtttcttggaaatcctccaaccaaatagcagttttcctaacttgattagcttgagctgacagactgttagaatacagttctctggccacagctgatgagggctttctgtactgcacacagattgtgtactgcaccccagtccaggtgactggtacccactcgagttgtgccgtgcaaaacctgtccagtatatgcatgtggtggccctactgactggtaatggttagaggcatttatggattttaagctttgaggaaaaaccatgacttttaacaaatttttatgggttatatgcctaaacccttatgccacatagtggtaaataattatgaaaaatggtctgttcataattggtaggtgccttttgtgagcagggagcataattattggtttattatggtaattatggtgattttttaaatatcatgtaatgttaaaacgttttctaacagtttactgttgcttatctccaagatattatggaattaagaatttttccagatgagtgttacatagattctttgaatttagtataaaagtactgagaattaagtttgtacttccataagcttggattttaaacactgatagtatctcatgagtaatgtgtgttttgggagagggagggatgctgattgatatttcacattgtatgaaataccatgtttgaaactcatagcaataatgctatgctgttgtgatccctctcaagttctgcatttaaaatatattttttctttataggaattgatgtataccatgaagtcattgtcagttgtagtagctctgatgttgaatgagatatcatgttttagcattccattttactgactagggtagaagaacacttttcttggctacatttggaggatacccagggagtcttgggtgttccttatctggggaagcaaacatttcactagtctctttttttcatcctttaaattgtaaattaaggattactcaagctcaccattattcaagattgggactcgcttcccagtcgacactctgccctgcctgtcattgctgcaaagagctgctgctttgccaacctaagcaaagaaaatacggcttctcttgcattattttcccttttggttggtttgttttctagaagtacgttcagatgctttggggaatgcaatgtatgatttgctagctctctcaccacttaactcactgtgaggataaatatgcatgctttttgtaattaactggtgctttgaaaatcttttttaagggagaaaaatctcaaccaaagttatgctcatccagacaagctgacctttgagttaatttcagcacaactcattcttcagtgcctcatgactgaaaacaaaaaacaaaaaaacgaaagcatcttcacaatgaagcttccagatagcaccgttttgctaaaagatacattctcattgttttccaacagtgatggcttccacataaggttaaacaaactaggtgcttgtaaataatttattacagtttactctatcgcatttctgtaacatgaaatgcatgcccttcttcaggggaagactgtggtcaagttaaaaaaaaaaaacaatattaaacaacatgaaactgcagtctgtttttgaaaatgagaatgtcctaagtgattcagaagagaggagggaagttgtgcactctgaaaatgcatgaaaaacaaaggcaaaaactagtgggaaatgtgtagaactgttaactgagacggcttcgagtcttccttctggaatctgttaaatttcacaaagtcatgagggtaaatggagaaaatatttctgggattacaatgaatgtaagcccaaattgtggaattgccagtaacctggatggggaaaagcatttcccatagcactccatgtaatatgagtgctctgtgagatgttcatcagtgttttatagaaatggtgttgctgggaaaccaagtttgcacctggaaacttacaatgcactttagcgcagtaagggcttggcatccggtagtgaaaaactgtctaacccagcattgcccaaactattttgacaccaggacctttttctcctttgggatacttatgaacctctcactaatgtcctgtggagaacattttgggaaacactatgttagatagttctttaaggagacaaaacggtaatgaacagatagcactggggcagaatatgcatgcattttgtaacgtccagtgtggcgttgaatagatgtgtatttcctcccctgcagaaaataagcacagaaaattataatgtaggtgatcggagctctttcctttgatagagagaacagccccaatgatcctggctttttcactgaacgtatcagaatacatggatgaattggggtaaataaggttttaattcagatctagaagaaagtattgtacgtttgaatgcagatttttatccacagatagttgtagtgtttagacatgacaggacctatcgttgaggtttctaagacttactatgggctgtaaacctgttttttaaaactattttagaaacctgagacttgccgtctggcattttagtttaatacaaactaatgattgcatttgaaagagattcttgaccttatttctaaacgtctagagctctgaaatgtcttgatggaaggtattaaactatttgcctgttgtacaaagaaatgttaagactcgtgaaaagaattactataaggtactgtgaaataactgcgattttgtgagcaaaacatacttggaaatgctgattgatttttatgcttgttagtgtattgcaagaaacacagaaaatgtagttttgttttaataaaccaaaaattgaacataaaaacc

SEQ ID NO: 29 - DNA, 1448 bp, Homo sapiens
taccaatctgaagggggaagcggcgccgccatcgcctcccggcgctccctccccgactcctaagtccttcggccgccaccatgtccgcctcggctgtcttcattctggacgttaagggcaagccattgatcagccgcaactacaagggcgatgtggccatgagcaagattgagcacttcatgcctttgctggtacacggggaggaggaaggcgccctggccccgctgctgagccacggccaggtccacttcctatggatcaaacacagcaacctctacttggtggccaccacatcgaagaatgccaatgcctccctggtgtactccttcctgtataagacaatagaggtattctgcgaatacttcaaggagctggaggaggagagcatccgggacaactttgtcatcgtctacgagttgctggacgagctcatggactttggcttcccgcagaccaccgacagcaagatcctgcaggagtacatcactcagcagagcaacaagctggagacgggcaagtcacgggtgccacccactgtcaccaacgctgtgtcctggcgctccgagggtatcaagtataagaagaacgaggtcttcattgatgtcatagagtctgtcaacctgctggtcaatgccaacggcagcgtccttctgagcgaaatcgtcggtaccatcaagctcaaggtgtttctgtcaggaatgccagagctgcggctgggcctcaatgaccgcgtgctcttcgagctcactggccgcagcaagaacaaatcagtagagctggaggatgtaaaattccaccagtgcgtgcggctctctcgctttgacaacgaccgcaccatctccttcatcccgcctgatggtgactttgagctcatgtcataccgcctcagcacccaggtcaagccactgatctggattgagtctgtcattgagaagttctcccacagccgcgtggagatcatggtcaaggccaaggggcagtttaagaaacagtcagtggccaacggtgtggagatatctgtgcctgtacccagcgatgccgactcccccagattcaagaccagtgtgggcagcgccaagtatgtgccggagagaaacgtcgtgatttggagtattaagtctttcccggggggcaaggagtacttgatgcgagcccactttggcctccccagtgtggaaaaggaagaggtggagggccggccccccatcggggtcaagtttgagatcccctacttcaccgtctctgggatccaggtccgatacatgaagatcattgagaaaagtggttaccagggccctgccctggggtttcgctacattcacccagagtgggcgattaccaactttcgttaccagctaggaaggggagaagagatgggggggttttaacacggggtttgctttacagccccggatgcagatttttagaagggagggcaggtgcgggtt

SEQ ID NO: 30 - DNA, 1394 bp, Homo sapiens
atgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagtgggtcgtgtgggcagcagatcgccaggcggcattgacaaaactgaggtacagccttcgtcagtacaatattgttggactgcccaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagtgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaagccaaaa

SEQ ID NO: 31 - DNA, 734 bp, Homo sapiens
gccgacaagatgttcttgctgcctcttccggctgcggggcgagtagtcgtccgacgtctggccgtgagacgtttcgggagccggagtctctccaccgcagacatgacgaagggccttgttttaggaatctattccaaagaaaaagaagatgatgtgccacagttcacaagtgcaggagagaattttgataaattgttagctggaaagctgagagagactttgaacatatctggaccacctctgaaggcagggaagactcgaaccttttatggtctgcatcaggacttccccagcgtggtgctagttggcctcggcaaaaaggcagctggaatcgacgaacaggaaaactggcatgaaggcaaagaaaacatcagagctgctgttgcagcggggtgcaggcagattcaagacctggagctctcgtctgtggaggtggatccctgtggagacgctcaggctgctgcggagggagcggtgcttggtctctatgaatacgatgacctaaagcaaaaaaagaagatggctgtgtcggcaaagctctatggaagtggggatcaggaggcctggcagaaaggagtcctgtttgcttctgggcaagaacttgggcacgccaatttgatgggagacgccagccaattgagattgacgccaaccagattttgccgaaattatttgagaagattttcaaaattggtagttagttaaaaccgaggtccttttcagaccccaatttt

SEQ ID NO: 32 - DNA, 692 bp, Homo sapiens
tgcagcgcgtgcgtgctgcgctactgagcagcgccatggaggactctgaagcactgggcttcgaacacatgggcctcgatccccggctccttcaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcgacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagagagctgtgctgatggagaagccagatgtggtagtagggaccccatctcgcatattaagccacttgcagcaagacagcctgaaacttcgtgactccctggagcttttggtggtggacgaagctgaccttcttttttccctttggctttgaagaagagctcaagaagtcttcctctggtcactttgcccccggattttaacaaggcttttctcatgtcagctacttttaacgaggacgtacaagcactcaaggagctgatattacataagccggtat

SEQ ID NO: 33 - DNA, 517 bp, Homo sapiens
ctgccacgcacgactgaacacagacagcagccgcctcgccatgaagctgctgatggtcctcatgctggcggccctcctcctgcactgctatgcagattctggctgcaaactcctggaggacatggttgaaaagaccatcaattccgacatatctatacctgaatacaaagagcttcttcaagagttcatagacagtgatgccgctgcagaggctatggggaaattcaagcagtgtttcctcaaccagtcacatagaactctgaaaaactttggactgatgatgcatacagtgtacgacagcatttggtgtaatatgaagagtaattaactttacccaaggcgtttggctcagagggctacagactatggccagaactcatctgttgattgctagaaaccacttttctttcttgtgttgtctttttatgtggaaactgctagacaactgttgaaacctcaaattcatttccatttcaataaactaactgcaaatcacaaaaaaaaaaaaaagtcgacg

SEQ ID NO: 34 - DNA, 322 bp, Homo sapiens
tcaagctgtgggtgagaagctctctagcagggactctgaccttatggaggatcgctgtttcccccatttttccttttcacccaaaaaagtcctgcttctgtcacccttcaaacagcctgtgagcctaaatttttgtggccatgggacagacaaggaccccgtcttcagctgaactaaggaaaagtcctgcgacatctttggccatcaaactccaacccagtcacccaaccagagcctctgaggaatggccccttcttgcggggaaccctttacaatgggcctcttgactgatgtttccccaaaacagtgcccctgtcatcag

SEQ ID NO: 35 - DNA, 1559 bp, Homo sapiens
gcacgagttgagagtgagtgtgtgtgtgtgcgtgtgcacgtgcacacatgtgcacggttgtatgtatgggaaataaacttataaatggggacgtattggagaaggaaatacatagacctacaactttgagcaaatagcagtgatgttttaggaactgaaatgtcacacttaaagtcttcagcccagctacttccctatttttggcggggagaagagggcctgattagaactgttctggttgtgtttggcgggaggggaataatttttgttcagtccttcttagtgaccaaactttaatttttaagaataatatattgacttactgaactgaagcattctgagttgaaaggagctccagaggagtggagttctgtgttgctcacatgttaaaagcttgctcaccttcagagcagagggaatacctatcttcagatatccgcccattttcatctcttcattatagtcaaacagtgtgacttgagagtgttgctctggtgtctgtattctggcttatgaagattatttgaaaaagaactcttactacattgaaatgcagacttttaaaaatttaaatattggattaggcagtcaaaaaaccaaacaagcataaaaggtcaataagttgtaatcttaaaagtaaaggtggaaaactcattataaatggaagaaaagttttgatttccttttttgtttgatgggcagtatgccatattatacccaaagttcttttaaaaaatatttccatcaaccatttttatttaaaataaacatttgagggaagttaccaaggcagcttttttcctcaaaagtaacctgttcctctttggaatagcacattttaggggcatggttaatacctgagatttttactcagtaaatcctgatggttactgtgtgtaaaatatctttaagtaggattgaaggcctctgtgggggaataaaatattaccaaagtctataaaaataaattttacatgttctcttttatgacagagagcagcactggttctgttatttttaaaatgaataattgatttcttgataggtgtttaatatttcttccctcactgctgattcttagatagaaaccattctttatatttgatagactgctttcagaaaacccttatcaacaagtgtacaatacttatctaaaactatacatttagaatggagcagtttaatactagatctcagaagttttgaaaaatagcaaagaagactggatttggaaagcatggtctacaattggttgttaaattctgaagctatgaagaataaatgtttcaactttggattatgaaaccccatttatgattttttaaatacacttgaaataaaaatgattaaactaaattttggtccagtgacattactttgcactgcataatccattatacgttgtacgacttttttttttggtttgaattaataactgagagttttgtgtgaagctacggcatatctaaccggagaatttcggatgccttatacggtgattatattatatgggggcatttgtagtgcagcggaagacggaatttatgcctttgggaaac

SEQ ID NO: 36 - DNA, 1072 bp, Homo sapiens
cacacgtgctgacggcggggacattcacatccataagaagaaatctcagcaagtgttcgcgtcccccagtaaacaccccatggacagcaagggggaggagtccaagatcagctaccccaacatcttcttcatgattgacagcttcgaggaggtgttcagcgacatgaccgtagggaaggagagatggtctgtgtggagctggtggctagtgacaaaaccaacacgttccagggggtcatctttcagggctccatccgctacgaggcgctcaagaaggtgtatgacaaccgggtgagcgtggccgcccgcatggcacagaagatgtcgtttggcttctacaagtacagcaacatggagtttgtgcgcatgaagggcccccagggcaagggccacgccgagatggcggtcagccgagtgtctacaggtgacacagccccctgtgggactgaagaggactccagcccagcttcgcccatgcacgagcgggtgacctccttcagcagaccccccaccccagaacggaacaaccggcctgccttcttctccccatccctcaagaggaaggtgccccggaaccggatcgctgagatgaagaagtcgcactcggccaacgacagcgaggagttcttccgggaggacgacggtggagccgatctgcacaatgcaaccaacctgcggtctcggtccctgtcgggcacaggacggtccctggtcgggtcctggctgaagctgaacagagcagatggaaacttccttctctatgcacacttaacctacgtcacgttgccgctgcatcggattttaacagacatcctggaagttcggcagaagcccatcctgatgacctagccgcgtgcggagcctgcgcagagccccggccgggcccagccctcggagtgctgccaagtgcctacctgtccaccgccaccggggtctgcgatggcacgccagtgttggagccgcagccaggcgaggccactcgactgccggggccggggccgactgcacgaacaccagcccaaactgaagtgcctctgacgggccctgctggcgctgcttccgccctgtgccc

SEQ ID NO: 37 - DNA, 454 bp, Homo sapiens
gtgctgcatggagtgagtggcggcatccaccgtgaggaggagaggagctctgataccctcaggacccgccaggaggggcatcacggaggcttctggacgacttggagctgtgtcctggggagaaaaccgctcctgtgtgggccctgagtgctgaggaggaagctgccatgcacttttccctggcatttttcctgcatggttcgtctgtttttttgcaaataacatgttgtcatgaatttttatgcatgaggcatatttcatcatgtctgtatgctgaagtccccttcatcctttcaattggttggtggacaggagagagaggtccaaggtgccctacatcgtgcgccagtgccgtgggaggagatcgagcgccgaggcacggaggaggtgggcatctaccgcatgtctggggtggccgcagacatccaggcactgaaggcagccttcaacgtca

SEQ ID NO: 38 - DNA, 700 bp, Homo sapiens
cttgtcggagccctaaccaggggtatctctgagcctggtgggatccccggagcgtcacatcactttccgatcacttcaaagtggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctgggttcccagcggcaaaggaaggcccgtttacatggggttgatgatgttatttgtggcaggtgggattttttgccctttacattacagcagtgaggccggggc

SEQ ID NO: 39 - DNA, 914 bp, Homo sapiens
ccggcctgcggtgggcagcagctcaggttctccaaatcattgcgtagttccgaataccctcggccacacctggccttctccatgctcggaataacttcctgcagcgaccaacaggctaaagagggggaagggatccagcaccggctcctcctccggcaaccacggtgggagcggcggaggaaatggacataaacccgggtgtgaaaagccagggaatgaagcccgcgggagcgggaaatctgggattcagggcttcagaggacagggagtttccagcaacatgagggaaataagcaaagagggcaatcgcctccttggaggctctggagacaattatcgggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagccgagtcagaactacaattacaaccagcatgcgtatcccactgcctatggtgggaagtactcagtcaagacccctgcaaagggggggagtctcaccttcttcctcggcttcccgggtgcaacctgggcctgcttgcagttgggtgaagttttggtaaggcaatttcttgcaaccaaccaccgaaggccccggaaaaagcactgggttcgtcaagggaagctccttccccctttggggcccccagccttgtggcaggcccctgggcccgggttg

SEQ ID NO: 40 - DNA, 1669 bp, Homo sapiens
gagctgcagcagagcaggtaacagctcttgcacctgtttctcttgcacctgacgtgcagctgctcctacccacctctcctggctgagccttgcctgatacagcagcccggaggcaccacttgcttcccgagtctcaccctcccaggcagctcctacactcaactgcttctctaggaaaggtctcacctccagcctggagcagtcgggattacagaaagccccatccttggcttagggagcgccatgacgactgaaattggttggtggaagctgactttcctccggaaaaagaaatccactcccaaagtgctgtatgagatccctgacacctatgcccaaacagagggagatgcagaacccccgaggcctgacgctggaggccccaacagcgactttaacacccgcctggagaagattgtggacaagagcacaaagggcaagcacgtcaaggtctccaactcaggacgcttcaaggagaagaagaaagtgagagccacgctggcagagaaccctaacctctttgatgatcacgaggaaggacggtcatcaaagtgaagggctgaggagggtgctagcacctcttggctccctgccatcagccagatctgagacaggaccttgccacgctggcctctttggccatagctgaagctgtggggccagttgatacctgctggcaggaaatggctgttttttaggtttgtatttatgtgccgccacttttgtaaggcctgggagatcccagggtcctccaccctccccctgaccacatacaaaggcactctagttcaagagtgaaaagtctcacccaggaggaacagccctccttgaagcaatggcagggccagcagggaggtgggcatggcagggaatggagagagtgagccagacagacttcacctccttactggacacagggtcaagggcgagtttcaattgctgctccctttactttctctacctgtgactactccctggaccaatcctgaggagggcacattttccagaagccacgtgataggggctggtttctgtggagccagaggcagagacactgaacttgagctcacctcctaacaccggcagtaaacttcctggaactttgccctcaggtgcggaggggacagaggaccctggcactctgttagggtgctgtagaagactagattgatggtagtttggcctgttagttcctgttttggccatgacttttgcagatggcaagtcacacaccctcaaagggaagctacacgggccaaatcgggggagtgggtggggaattttctcctctccctttcctactataatagtatttaagacatatcagctccagagatgagtcctggagccttgaattttgtttaacaaaataattgtaggtttctctctgtaataacaacgctggaaaggcagagaacctcttttatgctcatgtcttgcatttattgagatgactgtttctcatgcctttatgttccttcatgtaagtaaagtggacctttgtgctcaaaaaaaaaatttcaagcttcaggaaggggttcccaaggtgtgacaatgtaggaacctgggtcactaatttttaccatcaaacctagccttagtatggggatggggcaagcagaaggagctagttacacctcagtggtcagttctctccagtcaacagaga

SEQ ID NO: 41 - DNA, 355 bp, Homo sapiens
ccggcctcccctcgctctgaggctcggggtccccagctccgcgtaaactgcacgatttcgccctctgctcagctcccctctgccccctctttccaagagagacttccagatcccacattttcttgactgattttgaagctgtctgtttgcattctgattgggaacactgggatcattttcatcatgccgacagtggtggtaatggatgtatccctttccatgacccgacctgtgtctattgaggggtccgaggaataccagcgtaagacctagcagcccatggtttaacgatgcttgttttgagcacatggccacaaattacaagcttgaatttacagcacttgtggttttttca

SEQ ID NO: 42 - DNA, 2628 bp, Homo sapiens
gggtgcgcctgctttcgccctccttctccagcgggaggggcgcggacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccctgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggagatgcttatagccacaacatctattttaccaatattgtttccattacactaccttggattttgcatgagtgagtatagtaacccaagatgccataaaaaaaaacttgatcgttttctgacttaatcagttactgtggtttcactaaaagctaccgtggtggagtgaagtcagtcagggaaggtttgtttatgttacatttatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatatttgaaaaaaaaaaaaaaaaaaaaa

SEQ ID NO: 43 - DNA, 2535 bp, Homo sapiens
agttcggcacagggggaggaacctggccctgggaggaggctgttgcgtgctcctacagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgtaaaaaaaaaaaaaaaaaaaaaaaaaaaaaaaaaaaa

SEQ ID NO: 44 - DNA, 805 bp, Homo sapiens
ggcacgagcggcacgagccatctccatccccggagcatctgtatgattcagaagtacaaccacgatggggaagcaggtcggctggaggcttttagccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtgtgcatgtggggagccttctggaacacgttgctttgcccagtcagtggtgctgagggggtatagacagagcatgccacacaagccacagacttaat

SEQ ID NO: 45 - DNA, 1279 bp, Homo sapiens
cggaagtagccgcaggcatggcggcggctatgccgctgttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgttacatccactaccagcctgcccaggaccggctgcaaccccacctcctggagatgctgattcagctgccggccaa

SEQ ID NO: 46 - DNA, 1923 bp, Homo sapiens
gcgcaagacacaggaggcccaggccggcagtcaggacatggcggcgatttgcagattccaatctctctgtttctgcggcgattgaacacccaacattggcgaccgggatcgcggaaagtgatggctgtcgtcccggcgtctctctcaggacaggacgtgggatcatttgcatatcttacaattaaagacagaataccacagatcttaactaaggttattgatacattgcatcgacataaaagtgaattttttgagaaacacggagaggaaggcgtggaagctgaaaagaaagctatctctctcctttctaaattacggaatgaattgcaaacagataaaccatttatccccttggttgagaaatttgttgatactgatatatggaatcagtacctagaatatcaacagagtcttttaaatgaaagtgatggaaaatcaagatggttctactcaccgtggttgttggtagaatgttacatgtatcgaagaattcatgaagcaattatccagagtccaccaatcgattactttgatgtatttaaagaatcaaaagagcaaaatttctatgggtcacaggaatccatcattgctttatgtactcacctgcaacaattgataagaactattgaagacctagatgaaaatcagctgaaagatgagttttttaaacttctgcagatttcactgtggggaaataagtgtgatctgtctctctcaggtggagaaagtagttctcagaataccaatgtactaaattcattggaagacctaaaacctttcattttattgaatgatatggaacatctttggtcattgcttagcaattgcaagaaaacaagagaaaaagcttctgctactagagtgtatattgttctcgataattctggatttgagcttgttacagatttaatattagccgacttcttgttgtcctctgaactggctactgaggttcatttttatggaaaaacaattccatggtttgtttctgatactactatacatgattttaattggttaattgaacaggtaaaacacagtaatcataagtggatgtccaagtgtggggctgactgggaagagtatattaaaatgggtaaatgggtttaccacaatcatatattttggactctgcctcatgagtactgtgcaatgcctcaggttgcacctgacttatatgctgaactacagaaggcacatttaattttattcaagggtgatttgaattacaggaagttgacaggtgacagaaaatgggagttttctgttccatttcatcaggctctgaatggcttccatcctgcaccactctgtaccataagaacattaaaagctgaaattcaggttggtctgcagcctgggcaaggggaacagctcctggcctctgagcccagctggtggaccactggaaaatatggaatatttcagtacgatggtcccctttgacttgatttaggagctctcagttgcatagaaagatctggtgagcaccttttcatccccagaaaaggagcacgtgaattgagtcgcctggcggctctgtacgcgctcagggaagcttagcttcttggtgcccatctacgtgcactggatgatttttcttttgaacattttgccccactacactgtttttggggatagctgggttaagcaagttaaagatatttacatttatattggagattttaagcaacttttttttcagggtaaatatataatttcaaagtgcttttaaatggaccttaattttgaagtgggtagggccaaaaaataaagggagggctcctttgaggtaggtacccttggcctttcctaaaaagcccctcaatgggatttagatccgggggggtggggttattttccttggtttggccatgaaaatccttggaaccggcttatgcccttttgaaaaggggggttttt

SEQ ID NO: 47 - DNA, 706 bp, Homo sapiens
cattttacgacaggcgggattgttttgtggctgtcagctttctccgtggtctgagtttgtggctgcatttttatctctggtggctctgctacggcggcgcagaaatgaggcagaagcggaaaggagatctcagccctgctgagctgatgatgctgactataggagatgttattaaacaactgattgaagcccacgagcaggggaaagacatcgatctaaataaggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttgagtattccacccagtcttacactggctatgagcaacctccatgagagctattccgtgccagatatggacccttttccttacaggacaaggacaccggattaggaacagtttaaaacaagttgggttcgtagtgtggggttaagtgggagtttgtttgtggatggggtgggaactttttggggccgttccagaggattacagagttatttttatttcggaagtttacgtgatgggttttccg

SEQ ID NO: 48 - DNA, 749 bp, Homo sapiens
gacctatcctcatctgtgcaaggaggagtggccaactctggagcccaggctgttgcttcctggtctggtggtgaatcctccatagtctggtgagtgtagtgcccaactctggagcccaggatgttgcttcccggtctggtggtgaatcctccatagtctggagatctcagccctgctgagctgatgatgctgactataggagatgttattaaacaactgattgaagcccacgagcaggggaaagacatcgatctaaataaggtgaaaaccaagacagctgccaaatatggcctttctgcccagccccgcctggtggatatcattgcttgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctgggtgggacctgattctgattttgagtattccacccagtcttacactgggctatgagccaacctccatgaggagctattccgtgccagatatggacccttttccttacaggacaaggacaccggattaggaacagtttaaaacaagttgggttcgtagtgtggggttaagtgggagtttgtttgtggatggggtgggaactttttggggccgttccagaggattacagagttatttttatttcggaagtttacgtgatgggttttccg

SEQ ID NO: 49 - DNA, 857 bp, Homo sapiens
accttaccaaggggagaaaaaaaccctccactttggctcactgtgggtttggcactaagaggcacgatatctgaaggaggtcattccagttttaaaagtacggacagtgctgttggaactgaccacaaaaatgtattgttaaaaaaaaattgaaaaccagcagtgatttgggtccccctgaaacctctgtgaatcggaggtgggcccaggagggtgcaggacgcagcagaaatagtcccagaaaggagagacgggtcatgcagcgggcttgtgcttttttgtgtgtgtttgtgtgttttacaccatacatctccaaatgaagtatttattaacaattgtagtgtaagcctgtgataaaatagcacaaaggttctttaaagaagttcacttttaaggcatcagaaaagttaatgtggcaaacattttaattaaaacatcagaagtaaattttattttaaactttaggcctctgaatttttccagtaaacacagttcagctatgtggcaaagtcaatgggtggcatctaaaatgactttttacattctacaaaaaaataaaataaaataaggacacagccccaaacggtgtcacctcttcgcggccgctccacatgcacagaatctactaggatttgtcacggccgggtggcacccgatttgttttgactatacaacaaacttttttttcaaaagtatttgttcaggataactttaaaaataatataaaaataaacaatggatttgacttttccctcaaaattgaaaagaaaggggtggggggaggtgttaaccattggcctttttttttttggaggggccccattgggattgtaaggccctggggttccggcctttcc

SEQ ID NO: 50 - DNA, 268 bp, Homo sapiens
ccgcgcccggcccccaggcaattttaataataaatcttaatagatggggtaagagctgccttcatcccatacagagaatacaatggtgctagactaagtagagattttatttcagcttaaagattctgtttgatgtctgaaattacatgtttaggcggcatggggaacaggactgttctttagcatcagtttcacaattactttaatctactaggtttcattcaccttataattctgaaatttcatcagcagtggggaacagaaaagg

SEQ ID NO: 51 - DNA, 297 bp, Homo sapiens
ctgatgtgcactctaggttagtaaccatttttgtgaaaaatttagagaaattctttgagcagcttccactgaaacactaaaacccaatagggccaaaggcccataacctgaggaaaccttatttattgcttaatccaacataggctatgaaagttttgagtttcctcttgtgtattagaatttcattcctatttgttgtagagagtatagtacggggaatcagtaaattaaatgaagtaaactaaagattacacctttgctgctggcactaagcgaaaagcaaaaccagtggctgtc

SEQ ID NO: 52 - DNA, 590 bp, Homo sapiens
acggtcaaaatgataactcatgtattttattccaacaacatttggtttataaaggaatacaaacaggcacaaaacatggttcagaagatttattaagtaaacttgctaaaatatggacagatacacttagcagtcaaacagttgaatattcattgctacctcattaaagtttttgtatctgtattaccaggtccaaacataaaaaccacctctgttcaaaaaataaatgttcagagagctgtatgttctttgttctggtatgtacattttaaaaaaacacctctttccagtcttgctaaccaagaatattagtcatataaaagaacttagaatttttttccccaagtacaagctatcttttgctccaaaacagttctgaaggttttatttatattttatcttatcccgagggaccaacagcaggcatacctttgccaggccttcttgcagaaagacacagagccgtaaaggcaaaaataaaattgcaataaagtatatggtattgggggcagggagaaccagaaaccctcaaggggaccaatttttagcacgttctttttttagggtttaccctgtggagtaagaactag

SEQ ID NO: 53 - DNA, 1714 bp, Homo sapiens
ggaaggggaagtttcgcctcagaaggctgcctcgctggtccgaattcggtggcgccacgtccgcccgtctccgccttctgcatcgcggcttcggcggcttccacctagacacctaacagtcgcggagccggccgcgtcgtgagggggtcggcacggggagtcgggcggtcttgtgcatcttggctacctgtgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcagatttggaggccaatcactgccaccttttatttccctgtgggtccaggaactggatttctttatttggtcaatttatatttcttatatcagtattctacgcgacttgaaacaggagcttttgatgggaggccagcagactatttattcatgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcggtaatcaatgagcttattggaaatctggttggacatctttattttttcctaatgttcagatacccaatggacttgggaggaagaaattttctatccacacctcagtttttgtaccgctggctgcccagtaggagaggaggagtatcaggatttggtgtgccccctgctagcatgaggcgagctgctgatcagaatggcggaggcgggagacacaactggggccagggctttcgacttggagaccagtgaaggggcggcctcgggcagccgctcctctcaagccacatttcctcccagtgctgggtgcgcttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctgaataatgggttttagcgggtcctagtctgctggcattgagctggggctgggtcaccaaacccttcccaaaaggacccttatctctttcttgcacacatgcctctctcccacttttcccaacccccacatttgcaactagaagaggttgcccataaaattgctctgcccttgacaggttctgttatttattgacttttgccaaggcttggtcacaacaatcatattcacgtaattttccccctttggtggcagaactgtagcaatagggggagaagacaagcagcggatgaagcgttttctcagcttttggaattgcttcgacctgacatccgttgtaaccgtttgccacttcttcagatatttttataaaaaagtaccactgagtcagtgagggccacagattggtattaatgagatacgagggttgttgctgggtgtttgttccgagtaagtgagaaggtgagtggattgactac

SEQ ID NO: 54 - DNA, 1340 bp, Homo sapiens
ctcgagccgctcgagccgaatcggctcgagctgaaaaagggctacctgaccctgtcagacagtggggacaaggtggccgtggaatgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctgtccgacggcgacggcaccgtggagaaaggcttcaaggccgaatggctggcagtgaaggacgagcgtctgtacgtgggcggcctgggcaaggagtggacgaccactacgggtgatgtggtgaacgagaacccggagtgggtgaaggtggtgggctacaagggcagcgtggaccacgagaactgggtgtccaactacaacgccctgcgggctgctgccggcatccagccgccaggtaacctcatccatgagtctgcctgctggagtgacacgctgcagcgctggttcttcctgccgcgccgcgccagccaggagcgctacagcgaggaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttaactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtaagcatgaaggtggacctggtttgctgggaacccgagggctaaccccctttttcttcccaaatttggtgccttggaagaatcaggtccagccctgaagatccttgggg

SEQ ID NO: 55 - DNA, 765 bp, Homo sapiens
caggattgaaacaagatggcgggttcgtggtgagaagccgtcaaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagggggacctattccttttttcgtttt

SEQ ID NO: 56 - DNA, 1647 bp, Homo sapiens
gcagccggagtaagatggcggcgctgagggctttgtgcggcttccggggcgtcgcggcccaggtgctgcggcctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtgtgtatgttcatgtacacttggctgtcaggctttctgtgcatgtactaaaaaaggagaaattataataaattagccgtcttgcgcccctaggcctaaaaaaaaaaaaaaaaaaaaaaaaaaaaaaaaaaaaaaa

SEQ ID NO: 57 - DNA, 1166 bp, Homo sapiens
cgccgcctgcgcgggggggagcccagcacagaccgccgccgggaccccgagtcgcgcaccccagccccaccgcccaccccgcgcgccatggaccccaaggaccgcaagaagatccagttctcggtgcccgcgccccctagccagctcgacccccgccaggtggagatgatccggcgcaggagaccaacgcctgccatgctgttccggctctcagagcactcctcaccagaggaggaagcctccccccaccagagagcctcaggagaggggcaccatctcaagtcgaagagacccaacccctgtgcctacacaccaccttcgctgaaagctgtgcagcgcattgctgagtctcacctgcagtctatcagcaatttgaatgagaaccaggcctcagaggaggaggatgagctgggggagcttcgggagctgggttatccaagagaggaagatgaggaggaagaggaggatgcagccaggctgaagtcctgaaggtcatcaggcagtctgctgggcaaaagacaacctgtggccagggtctggaagggccctgggagcgcccaccccctctggatgagtccgagagagatggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttcccctcgcctgctagggctgcggcttctgacttctagaagactaaggctggtctgtgtttgcttgtttgcccacctttggctgatacccagagaacctgggcacttgctgcctgatgcccacccctgccagtcattcctccattcacccagcgggaggtgggatgtgagacagcccacattggaaaatccagaaaaccgggaacagggatttgcccttcacaattctactccccagatcctctcccctggacacaggagacccacagggcaggaccctaagatctggggaaaggaggtcctgagaaccttgaggtacccttagatccttttctacccactttcctatggaggattccaagtcaacatttgtctgaacggcttgtaacagggttcaggttg

SEQ ID NO: 58 - DNA, 487 bp, Homo sapiens
ctcagatcggtggacgtgctcgcctccactcggggccaggtctatgtcccggtttcccgcagtcgcgggcagggcgccaaggcggcaggaggagggtgagcggtcaagagacctccaggaagagcggctctcggctgtttgcatcgccgatagagaagagaaaggatgcacgtcccaggagggaggaactactccaacttttcctattcagaaacaaagaaaaaagattattcaagctgtgagggacaattcattccttattgttactggaaatacaggaagtggtaaaacaactcaactcccaaaatatctatatgaagcagggttttcacaacatggtatgattggtgtaactcaaccacgaaaagtagctgctatatcagttgctcagagagtagctgaagaaatgaaatgcactttgggatccaaagtaggataccaagttcgttttgatgattgcagttctaaggagacagcaatcaaatat

SEQ ID NO: 59 - DNA, 1630 bp, Homo sapiens
aaactgtgtaatgccccatgtaatccataaaattttaacttttccccctaacgtttttgctgaaaaatgttgggaaaccctcaacacgccttcctgaaaacaattaaaatacttgaaacctgtgaacctttcaaaaaaccctcaggttgggaaaagacccccaaaccttcttttaaggatcatttgtctcgcccatcacaggatcttggaaatgtttccctagggtgtgtaaaaattaacccaggggggaatgaagcacatttttctggcaaccaaacttgagttcctcagagaacagatgcagagagacctgctcctgcttgcccggctacaggggccactgtggagtcacactgaggctgtgaccggccataagcccaggagagcccgtggcagctgtgccgaggcgccaggacctctaagcggaagcttcccaagctaggaatggagcaacactgcaatgaaatgtgtccaccaagctcattgttcctcccgggtgcttataaagctcagatgtatagtgacgtatggacaaatacaaaaaaaaaaaaaaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaaaaccttcaaagcatgtttctttccctcaccacaacagaacatgcagtactaaagcaatatatttgtgattccccatgtaattcttcaatgttaaacagtgcagtcctctttcgaaagctaagatgaccatgcgccctttcctctgtacatatacccttaagaacgccccctccacacactgccccccagtatatgccgcattgtactgctgtgttatatgctatgtacatgtcagaaaccattagcattgcatgcaggtttcatattctttctaagatggaaagtaataaaatatatttgaaatgtacc

SEQ ID NO: 60 - DNA, 1272 bp, Homo sapiens
tgcgcgcgagcccgtgtccccacggcgggcagcagcggcggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaagacaaatcttcctattttcaagctgaaagaatctactgttagaagaagatacagtgactttgaatggctgcgaagtgaattagaaagagagagcaaggtcgtagttcccccgctccctgggaaagcgtttttgcgtcagttccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgcaaaaaaaaaaaaaaagaaaaagaaaaaaagaggggcggccgctct

SEQ ID NO: 61 - DNA, 1914 bp, Homo sapiens
tgcagcgcgtgcgtgctgcgctactgagcagcgccatggaggactctgaagcactgggcttcgaacacatgggcctcgatccccggctccttcaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcgacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagagagctgtgctgatggagaagccagatgtggtagtagggaccccatctcgcatattaagccacttgcagcaagacagcctgaaacttcgtgactccctggagcttttggtggtggacgaagctgaccttcttttttcctttggctttgaagaagagctcaagagtctcctctgggaaggcagagtcacttgccccggatttaccaggcttttctcatgtcagctacttttaacgaggacgtacaagcactcaaggagctgatattacataacccggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccaggtgccacatcatctcacagttcaaccaaggcttctacgactgtgtcatagcaactgatgctgaagtcctgggggccccagtcaagggcaagcgtcggggccgagggcccaaaggggacaaggcctctgatccggaagcaggtgtggcccggggcatagacttccaccatgtgtctgctgtgctcaactttgatcttcccccaacccctgaggcctacatccatcgagctggcaggacagcacgcgctaacaacccaggcatagtcttaacctttgtgcttcccacggagcagttccacttaggcaagattgaggagcttctcagtggagagaacaggggccccattctgctcccctaccagttccggatggaggagatcgagggcttccgctatcgctgcagggatgccatgcgctcagtgactaagcaggccattcgggaggcaagattgaaggagatcaaggaagagcttctgcattctgagaagcttaagacatactttgaagacaaccctagggacctccagctgctgcggcatgacctacctttgcaccccgcagtggtgaagccccacctgggccatgttcctgactacctggttcctcctgctctccgtggcctggtacgccctcacaagaagcggaagaagctgtcttcctcttgtaggaaggccaagagagcaaagtcccagaacccactgcgcagcttcaagcacaaaggaaagaaattcagacccacagccaagccctcctgaggttgttgggcctctctggagctgagcacattgtggagcacaggcttacacccttcgtggacaggcgaggctctggtgcttactgcacagcctgaacagacagttctggggccggcagtgctgggccctttagctccttggcacttccaagctggcatcttgccccttgacaacagaataaaaattttagctgccccaaaaaaaaaaaaaaaaaaaaaaaaaaa

SEQ ID NO: 62 - DNA, 608 bp, Homo sapiens
aatggaaccaggaattcttaattaagcccgaagttcccaagtctccttagcggaaaccggaaattgcccaaggaaagcaaagagggagatgaccagtgatacctccagtgccagaggtcactttgtggagccaaatgcgtgacatgggcagtcgagactcggcatcttctgtcccccgcattaatgactctcaggaaggaggatgtaattcaaggcaagtttctaattccgaagctgcctgttcatgttaacaggacttctttttattcgtcaagatgtactggttccctggcaccttaagggaaatcctgataaaggcaaacctgttgagccatttggtcccataggatcccaggacccaagtcctgtgtttcatcgttactaccatgtgttccgtgagggagaactggaaggtgcctgcaggactgtgagtgatgtcagaattctgcaaagctactacgatcaaggaaactggtgtgtgattcttcaaaaggcctgattatttacctgaacacatcatatataaagaagaaatgctcacttaaaaaaaaaagaggggataaattaattacccgtttaattaaagagaaaacttgtggggaagtacc

SEQ ID NO: 63 - DNA, 2674 bp, Homo sapiens
tgaagagaagttaaggtgaagagccgaagagcctgatgcgtgatgagcgtctaagaaaggagaagcaagagcagagaagagagagagaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttacaaagttgattgtctctgtcattgaaaagttttagtattaatctttttctaataaagttattgactctgaaaaaaaaaaaaaa

SEQ ID NO: 64 - DNA, 326 bp, Homo sapiens
gacaaatgagggtttggcatgcagctcgtcatcttaagagttactatcttcttgccctggtgtttcgccgttccagtgccccctgctgcagaccataaaggatgggactttgttgagggctatttccatcaatttttcctgaccgagaaggagtcgccactccttacccaggagacacaaacacagctcctgcaacaattccatcggaatgggacagacctacttgacatgcagatgcatgcttctgctacagcagccccactgtggggtgcctgatgggtccgacaactgcatctcgccaggaagatgcaagtggattaagcaca

SEQ ID NO: 65 - DNA, 888 bp, Homo sapiens
ctcgtgcggtgatgttgagcagaagatacaattcaaaagagaaacagccagtttgaaactgttaccccaccagccccgaattgtggagatgaagaaaggaagcaatggctatggtttctatctgagggcaggctcagaacagaaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagcctaagaaaatccctattgttccctgcctggctgatgccagttgacagccctgcaggttctaaagaaggaatagtggtggagtcaaaccatgactcgcacatggcaaaagaacgggcggctattgcagacggctaatttatg

SEQ ID NO: 66 - DNA, 202 bp, Homo sapiens
atcacaggggtacaaccagaacacatacagtacttgaaaaattatttccacctttggacacgacagttagcgcatatttatcactactatattcatggcccaaaaggaaatgaaatacgaacatcaaaagaagttgaacctttcaacaatattgatattgaaatttctatgtttgaaaaagggaaggtacctaagattgtca

SEQ ID NO: 67 - DNA, 1225 bp, Homo sapiens
ggccggtggaggcggcggctgcggcacggaaggggaagcgctgaggcggtggggcccacagccatggcggagctgttgcaggaggagctctcggtcctggccgcgattttctgcaggccccacgagtgggaggtgctgagccgctcagagacagatgggaccgtgttcagaattcacacaaaagctgaaggatttatggatgcggatatacctctggaattggtgttccatttgccagtcaattatccttcatgtctacctggtatctcgattaactctgaacagttgaccagggcccagtgtgtgactgtgaaagagaagttacttgagcaagcagagagccttttgtcggagcctatggttcatgagctggttctctggattcagcagaatctcaggcatatcctcagccaaccagaaactggcagtggcagtgaaaagtgtactttttcaacaagcacgaccatggatgatggattgtggataactcttttgcatttagatcacatgagagcaaagactaaatatgtcaaaattgtggagaagtgggcttcagatttaaggctgacaggaagactgatgttcatgggtaaaataatacttgattttactacagggagacagaaacaacctcaaggtgtacttgattcttcagaaaacctccaaagtagatgtggactcaagtggaaagaaatgcaaagagaaaatgattagtgtactgtttgaaacaaaagtacagacagaacacaaaaggtttctggcatttgaagtcaaagagtattcagcgttggatgaattacaaaaggaatttgaaactgcaggacttaagaagcttttctccgaatttgtacttgctctggtaaaatgaaatggaagacaggaatcttttagtaaaatagcagtgttttttgttgtttttgcattggatttggggagtggttaattgaaatagtcaattttaaagtttctctgaagcaaaatgataggcatcattctaacttcaggaacaaaagccagttctgttttatgaaatattaaacatgaagaaaacttgtatattctaatgtttgccaggaaaggctaggttcagtagatgagacattatttaaaagataaatttaaaaagatggtaaatgaacacttgtttttatagacaatatttgtttgaaactatgtaattttctggctaattttcttgtaattaaatgattttttaaaaaaagaa

SEQ ID NO: 68 - DNA, 1093 bp, Homo sapiens
gagggcgggcctgtttccggggaggcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccgggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggtgctttgcctttaactagagtgtgtgatggtagattatttcagatatgtatgtaaaactgtttcctgaacaataagatgtatgaacggagcagaaataaatactttttctaattaaaaaaaaaaaaaaaaaaaaaa

SEQ ID NO: 69 - DNA, 309 bp, Homo sapiens
cacaaagtgattgtggtatggaacaatattggagagaaggcaccagatgagttatggaattctctagggccccaccctatccctgtgatcttcaaacaacagacagcaaacaggatgagaaatcgactccaggtctttcctgaactggaaaccaatgcagtgttgatggtagatgatgacacactcatcagcaccccagaccttgtttttgctttctcagtttggcagcaatttcctgatcaaattgtagggatttgtttcctagaaagcacgtcttttactttcattcaaggtatctacagttattgg

SEQ ID NO: 70 - DNA, 380 bp, Homo sapiens
ctcatctgatcccttttatggccaaatcatccttcagagtagggaacactcagacattctgtgcatgttgttcccccaaagcatggtcatcacaaagtcctgagttctggtgtgtgctcccgcctcctgggtatacagagagaaggcaggaatcaggagttccagaagcatatacatgtggctaccccagcaacaagcggcatcctgtgctcagataagctgcatggttgggaagtgtttttcctcgcacgttgaggcttagtggagatgggcaccactgccatttgctcagaagaaggctggtctggtcctaactgcatcccacactgcccagatcattctagataggttattttctgaatgtttatagatttcttata

SEQ ID NO: 71 - DNA, 1253 bp, Homo sapiens
gcggcccgactccagttaggagccttgatgccggaggggacagtgggtcgccgagagcgcccggagggaaccgcctggccttcggggaccaccaattttgtctggaaccaccctcccggcgtatcctactccctgtgccgcgaggccatcgcttcactggaggggtcgatttgtgtgtagtttggtgacaagatttgcattcacctggcccaaaccctttttgtctctttgggtgaccggaaaactccacctcaagttttcttttgtggggctgccccccaagtgtcgtttgttttactgtagggtctccccgcccggcgcccccagtgttttctgagggcggaaatggccaattcgggcctgcagttgctgggcttctccatggccctgctgggctgggtgggtctggtggcctgcaccgccatcccgcagtggcagatgagctcctatgcgggtgacaacatcatcacggcccaggccatgtacaaggggctgtggatggactgcgtcacgcagagcacggggatgatgagctgcaaaatgtacgactcggtgctcgccctgtccgcggccttgcaggccactcgagccctaatggtggtctccctggtgctgggcttcctggccatgtttgtggccacgatgggcatgaagtgcacgcgctgtgggggagacgacaaagtgaagaaggcccgtatagccatgggtggaggcataattttcatcgtggcaggtcttgccgccttggtagcttgctcctggtatggccatcagattgtcacagacttttataaccctttgatccctaccaacattaagtatgagtttggccctgccatctttattggctgggcagggtctgccctagtcatcctgggaggtgcactgctctcctgttcctgtcctgggaatgagagcaaggctgggtaccgtgcaccccgctcttaccctaagtccaactcttccaaggagtatgtgtgacctgggatctccttgccccagcctgacaggctatgggagtgtctagatgcctgaaagggcctggggctgagctcagcctgtgggcagggtgccggacaaaggcctcctggtcactctgtccctgcactccatgtatagtcctcttgggttgggggtgggggggtgccgttggtgggagagacaaaaagagggagagtgtgctttttgtacagtaataaaaaataagtattgggaaacaaaaaaaaaaaaaaaaaaaaaaaaaaaaaaaaaaa

SEQ ID NO: 72 - DNA, 439 bp, Homo sapiens
ctaaggggaggacaggcagaaaccaggaatgccaacttaaacctgtttggtgctctgactgtttgttagtatcactctcaagaatgaagagaaacctcaacctttctgtttccggccaactttattgaatttgtttttttaaatgcagtttacatgcagtttctttgaaaagtcatgttgaatttagatctgttctctgagtaagacttggcgagtatgtgaaacttgactcaagttacatttctttttttctgtcccccaaacgttcacgcttcttataggctccactttgaggctctgatgaacattccagtgctggtgttggatgtcaatgatgattttgctgaggaagtaaccaaacaagaagacctcatgagagaggtgggaaggactttaactcctgtttttctggtggtttccctttggttgtaccttttaa

SEQ ID NO: 73 - DNA, 1252 bp, Homo sapiens
tggacctgcccgacgccctgctgcccgacttgcccgcgctggtgggccccaagcagctgatcgtgctgggaaacaaagtggacctcctgccccaggatgctcctggctaccggcagaggctgcgggagcgactgtgggaggactgtgcccgcgccgggctcctgctggcccctggcaccaagggccacagcgccccgtcaaggacgagccacaggacggggagaatccgaatccgccgaactggtcccgcacagtggtcagggacgtgcggctgatcagcgccaagaccggctatggagtggaagagttgatctctgcccttcagcgctcctggcgctaccgtggggacgtctacttagtgggcgccaccaacgccggcaaatccactctctttaacacgctcctggagtccgattactgcactgccaagggctccgaggccatcgacagagccaccatctccccttggccaggtactacattaaaccttctgaagtttcctatttgcaacccaactccttacagaatgtttaaaaggcatcaaagacttaaaaaagattcaactcaagctgaagaagatcttagtgagcaagaacaaaatcagcttaatgtcctcaaaaagcatggttatgtcgtaggaagagttggaaggacattcttgtattcagaagaacagaaggataacattccctttgagtttgatgctgattcacttgcctttgacatggaaaatgaccctgttatgggtacacacaaatccaccaaacaagtagaattgactgcacaagatgtgaaagatgcccactggttttatgacacccctggaattacaaaagaaaattgtattttaaatcttctaacagaaaaagaagtaaatattgttttgccaacacagtccattgttccaagaacttttgtgcttaaaccaggaatggttctgtttttgggtgctataggccgcatagatttcctgcagggaaatcagtcagcttggtttacagtcgtggcttccaacatcctccctgtgcatatcacctccttggacagggcagacgctctgtatcagaagcatgcaggtcatacgttactccagattccaatgggtggaaaagaacgaatgggcaggatttcctcctcttgttgctgaagacattaatggttaaaagaaaggactgggggcaacctggaagcagtgggccgacatcaaagtttcctctgcaggtaattttatgccaagcactttttaaaaagt

SEQ ID NO: 74 - DNA, 695 bp, Homo sapiens
tgttcattgcctcctgagcgtagtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaagtccaggaacgggattcgggaccgcgggtatgaccaagcagaccgggaagagggcc

SEQ ID NO: 75 - DNA, 2514 bp, Homo sapiens
cggcgacggcgcgggggcagctgggaatccggaatgctgcccgatggccctgggtcctcgctgtggggcaatccgggcttgcagacgagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggagtacactggagccccatattttgcagcaatctcagctctcaaagtgtgacagccccaatgctgttcatgaggtggagaagtggctgccccggctgcatgctcttgtcgtaggacctggcttgggtagagatgatgcgcttctcagaaatgtccagggcattttggaagtgtcaaaggccagggacatccctgttgtcatcgacgcggtgagttgacttctctcctcctggctcggactcccggaaggcctgtgcagtgagcacggctccttgttctgtgcaggatggcctgtggtaggtcgctcagcagccggccctcatccatggctaccggaaggctgtgctcactcccaaccacgtggagttcagcagactgtatgacgctgtgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaatttaaaaaaaaaaaaaaaaaaaaaataaaaaa

SEQ ID NO: 76 - DNA, 274 bp, Homo sapiens
cagagatctgctgtgattattccttttcacaaaccacaatgactctggaaaacctggctgtaaacaccagcactgccaccagctaaggatctgtgatcaggagtgccatctcacggtaacaggcagaagacaaaagtgaaaccgggctgatgcgaatcactgggaaactggctttggcacctccagagaatgaactgtttcatagcctagctgaccatccatgaaaatggctgcctggagaggcagtgatcagcccattccctgcaaggtgaag

SEQ ID NO: 77 - DNA, 449 bp, Homo sapiens
cgggtttagcggcagctcttcgggattgtttccattgccaccctaaccgtgctggcctatgaacggtacattcgcgtggtccatgccagagtgatcaatttttcctgggcctggagggccattacctacatctggctctactcactggcgtgggcaggagcacctctcctgggatggaacaggtacatcctggacgtacacggactaggctgcactgtggactggaaatccaaggatgccaacgattcctcctttgtgcttttcttatttcttggctgcctggtggtgcccctgggtgtcatagcccattgctatggccatattctatatttccattcgaatgcttcgttggtgtggaagatcttcagacaattcaagtgatcaagattttaaaatatgaaaagaaactggccaaaatgtgcttttaatgatattcaccttcctggtcg

SEQ ID NO: 78 - DNA, 346 bp, Homo sapiens
atataacatctgaattgggagatagctcattgtggcctgggtgctggacttttcatattaagtcctgtcttagccaagggagaagaatgtaaggataagaccaccaatatcacaggggctgtctgagcctttacctgtgattttgtaccactctgtggccttctggagcaatggacaaccaagtcagctatgcagttcataaaagtggacctggttatatgtcatccaacagcatatggtccctgcaagcctgttttggaagccaatattctataacctacaggaatccacttgaatctgatgtctttggaagcaatatattttcccagggttccaatggactacg

SEQ ID NO: 79 - DNA, 1329 bp, Homo sapiens
  modified_base (1): a, t, c, g, other or unknown
ncccccatcagttcgaatttctgcagtgagagcatctggggttattgtgaccaactgaaagtctcagagagtacccacgtgctccagcccttcctccccagcatccttgatggcttaattcacctagcagcccagttcagctcagaggtcctcaacctggtgatggagaccctgtgcatcgtttgtacagtagaccccgaattcacagcaagcatggaaagcaaaatctgccccttcaccatcgccattttcctaaagtacagtaatgatcccgtcgtcgcctcactggctcaggacatcttcaaggagctgtcccagattgaagcctgtcagggcccaatgcaaatgaggctgattcccactctggtcagcataatgcaggccccagcagacaagattcctgcagggctttgtgcgacaccattgatatcctgacaacagtagtacgaaatacaaagcctcccctttcccagcttctcatctgccaagctttccctgctgtggcacagtgtacccttcacacagatgacaatgccatcagtgcagaatggcggagagtgcttgcgggcctatgtgtcagtgaccctggaacaagtagcccagtggcatgatgagcagggccacaatggactgtggtatgtgatgcaagtggtgagccagctcctggacccccgcacctcagagttcactgcggcctttgtgggccgccttgtttccaccctcatctccaaggcagggcgggaactcggggagaatctagaccagattcttcgtgccatcctcagtaagatgcagcaggcagagacgctcagtgtcatgcagtccctgatcatggtgttcgctcatctggtgcacactcagctagaacctctcttggagttcctgtgtagcctcccaggacctactggcaaacctgctctagagtttgtgatggctgagtggacaagccgacagcacctgttctatggacagtatgaaggcaaagtcagctctgtggcactctgtaagctgctccagcatggcatcaatgcagatgacaaacggctacaggatatccgtgtgaagggagaggagatctacagcatggatgagggcatccgcacccgctctaagtcagccaaaaacccagaacgctggacaaacattcctttgctggtcaagatcctaaagctgatcatcaacgagctctccaacgtcatgggaggctaatgccgctccgccaggccactcctgcagagtgggagtcaaaggtgcacgaaggccccttacttcccaggaagacttttagcctgggcagatcaagttacaaattgtcaaattatccaggaa

SEQ ID NO: 80 - DNA, 805 bp, Homo sapiens
gcccccatcagttcgaatttctgcagtgagagcatctggggttattgtgaccaactgaaagtctcagagagtacccacgtgctccagcccttcctccccagcatccttgatggcttaattcacctagcagcccagttcagctcagaggtcctcaacctggtgatggagaccctgtgcatcgtttgtacagtagaccccgaattcacagcaagcatggaaagcaaaatctgccccttcaccatcgccattttcctaaagtacagtaatgatcccgtcgtcgcctcactggctcaggacatcttcaaggagctgtcccagattgaagcctgtcagggcccaatgcaaatgaggctgattcccactctggtcagcataatgcaggccccagcagacaagattcctgcagggctttgtgcgacacccattgatatcctgacaacagtagtacgaaatacaaagcctcccctttcccagcttctcatctgccaagctttccctgctgtggcacagtgtacccttcacacagatgacaatgccaccatgcagaatggcggagagtgcttgcgggcctatgtgtcagtgaccctggaacaagtagcccagtggcatgatgagcagggccacaatggactgtggtatgtgatgcaagtggtgagccagctcctggacccccgcacctcagagttcactgcggcctttgtgggccgcctttgtttccaccctcatctccaaggcagggcgggaactcggggagaatctagaccagatttcttcgtgccatccttcagttaagatggcaggaggt

SEQ ID NO: 81 - DNA, 420 bp, Homo sapiens
accaggtcaagctcaccccaaactattaccttcgatgcatgtgttgtcataccctgtggagatctccaaagtcaaaagcaactgtcagactcagagaagtatctgtgcccctttaagataaaaggctccccctatcaagacccttgttccttaacgaatgcaggaaaacaggtctgccatagctggaatgaggtggtgtggacaactgaatatcaaggctggacctcgtcaaccggtggttgtatgtccttaaaaccatacattcacttcactaaagaaagtaccccccataattgccagtataaccaatgtaatccagtgcaaatttctattctcattccaacttctactgaccctaaacctactttaagttgcggtatatggcatgggagccgaaatagcaggggcacatcttattgg

SEQ ID NO: 82 - DNA, 2143 bp, Homo sapiens
cggccgccctttttttttttttttttaagttgaacagaacattttatttctcagcaattctatgcgtacaaattaaacatgagatgaatagagactttattgagaaagcaagagaaaattcctatcaaccccaaggaggactcaaagtgaggctggaagaggacttagaagagtatgaaagtactctaagattttatctaagttgccttttctgggtgggaaagtttaaccttagtgactaaggacatcacatatgaagaatgtttaagttggaggtggcaacgtgaattgcaaacagggcctgcttcagtgactgtgtgcctgtagtcccagctactcgggagtctgtgtgaggccaggggtgccagcgcaccagctagatgctctgtaacttctaggccccattttcccctctgaaaataagagggttggatcaaacgatctctggggccttagcatctcaaatcctgtggatcctcctacttaccccttagagagccttactgggaagtcagtcattaatgatgtggccagttatttgcaagtggtaagagcctatttaccataaataatactaagaaccaactcaagtcaaaccttaatgccattgttattgtgaattaggattaagtagtaattttcaaaattcacattaacttgattttaaaatcagttttgtgagtcatttaccacaagctaaatgtgtacactatgataaaaacaaccattgtattcctgtttttctaaacagtcctaatttctaacactgtatatatccttcgacatcaatgaactttgttttcttttactccagtaataaagtaggcacagatctgtccacaacaaacttgccctctcatgccttgcctctcaccatgctctgctccaggtcagcccccttttggcctgtttgttttgtcaaaaacctaatctgcttcttgcttttcttggtaatatatatttagggaagatgttgctttgcccacacacgaagcaaagtaaataaagaccacaaatgttcaaattctaagccacttaatagcgttttgtacattaaaaatgacaagggttattatacaagtagccttttaaaaaattctcacacagaacagctttgtatttagacttaaagctgttgctactttgctagtgacgtttgtgttaacagtcagtgctctaggccattgattgattgattgtcagaatcagaagtgactacacaagagcattagccagacttttcagtgagaacaggtaacaggctggcaccagcacttggtacagcacgtggacaggacgacggaacccagagttctctgtctctccttcacagcagatggactcttctataggtggctgttaatttacacaaagttatattccagaatcaggaagccccgtgtcgccaacacttgaaggagaactatgttccagttttggtgttgaacttctcacgaaatacctactaccaaaaattgtgacaccttattagacacttccaaagtaccccccaaaagctgtttaaaagaccattccattttttcctacacaaagtgcatactaaaatttcacaataatcatcttcagatgtacattttatttagtacatttcacagttttcagtattcagtccctcatgaacattttatagtcatctcttcggccctgttgtgaaatatgtgattccagttcaattcagagtgtatgattccgcttttcacgctgatcaagtaaatttatggtgtctcttttctgatcttcaacattaaaaacatctatgtttctgtcattccctgccagggctgcttgcttgtctgtctcagattctgcttcattttcatccatgttgtagtcatcttctcctctcagtttctgctggtttctcccttccccggcagcttcctgctcctcctcctgtccgtcggggatgacaagctggtctcgctcagggccctccatctctggattttcctggctcactgacagggcagcctgcacctgtggggtctggcccagttctccggctcccccgaagcctcttccacctacaggtctgtcttcaacacctgctcccggcctggctcctgcggcagcctgtccctctgaggctccgatcaacactgatctcatggttcccttccca

SEQ ID NO: 83 - DNA, 450 bp, Homo sapiens
tttttttaaagccagcttttcttcagatttttttggtgggcaggtcgtgaaagacaggtgaggaagtagatcttgggctcagcatgcctctaaaagtataatttcttttttttaatgtggaaagaaatgcataactctgtttctgttcctgtccccctctctgcctctgtggtgcctgagatactggggatcccacagctggggccactcagaggctaccaggaacgcttccagtttgcatctggctgttagtgccaggaccagaaacccacagacctcttcacagacctcctgaccgtgatgtccctgaagcctggaaggtgtccacacaatgaagcagaattgagtgatggggtgttttgtggaacccagtgaaactgtgttaacacagtggaactgtgttaattttgagtggaagttcaagttccgtggagttcattgggcccgttt

SEQ ID NO: 84 - DNA, 408 bp, Homo sapiens
tgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcagggctagttccaaccaagagtgtgctccagatgtgttggggccctaacttggcacagagt

SEQ ID NO: 85 - DNA, 311 bp, Homo sapiens
tacagtttttatcagtgatcacattttagtgtaatacatgaaactgaggcttgatagaaaacaggagagaaggcatgagtgcatggggtacatagggagatgagggcaagcatcaccaaggagcggcagtgagatagacgctctcatggactgctgctttacaacctccctggagagcaatttaaaaatatgaatcaagatccttttgatccactaatcatccagaaatctacacagaaatatgcacaaaaatatgtgggcatccattgactttccaacctcttctctttccagggggaatattccttaaa

SEQ ID NO: 86 - DNA, 487 bp, Homo sapiens
gtcttttgaaatctgtttccactacagctatggtcaagtctatcagccggtgctaccaggagtcactgccagggctgccgttctcctgaaccccagtggccagaatcataagccctgaccccatccctagaaagatgaggtcccagcaatggccagagcatttctcaccagttctgtgagatagcacataaaaatagagttctttgggcaaaacttttgggaagcaatgcatcctacatgggctgatattcagcctgagctgttctcaagaggagagtggtactggcagtttatggctgaaatccattctgattggttggagtctatgctataccagttgttaaacattttgagtatcactcttgcatactgttactattatatttcctctatatatagacagaaaggccatttttaggatattaaaggctctgaaaatttctgcagtagacccaactgaaggttctattaaggcagggttcctaaa

SEQ ID NO: 87 - DNA, 1902 bp, Homo sapiens
gaggaaaaagaacaatgaacagcaacgatcttgactgtgcaactcagacattcctgcagaaaagacatatgttgctttacaagaaggccaaagaactatggggccttcccagcatttgactgttcattgcatagaatgaattaaatatccagttacttgaatgggtataacgcatgaatgtgtgattttattaggggcatctgccaattctctcactgtggttccttctctgactttgcctgttcatcatctaaggaggctagatccttcgctgacttcaccattcctcaaacctgtaagtttctcacttcttccaaattggctttggctctttcttcaacctttccattcaagagcaatctttgctaaggagtaagtgaatgtgaagagtaccaactacaacaattctacagataattagtggattgtgttgtttgttgagagtgaaggtttcttggcatctggtgcctgattaaggcttgagtattaagttctcagcatatctctctattgtcttgacttgagtttgctgcattttctatgtgctgttcgtgacttggagaacttaaagtaatcgagctatgccaacttggggtggtaacagagtacttcccaccacagtgttgaaagggagagcaaagtcttatggataaaccctcctttcttttggggacacatggctctcacttgagaagctcacctgtgctgaatgtccacatggtcactaaacatgttatccttaaaccccccgtatgcctgagttgaaagggctctctcttattaggttttcatgggaacatgaggcagcaaatctattgctaagactttaccaggctcaaatcatctgaggctgatagatatttgacttggtaagacttaagtaaggctctggctcccaggggcataagcaacagtttcttgaatgtgccatctgagaagggagacccaggttgtgagttttcctttgaacacattggtcttttctcaaagttcctgccttgctagactgttagctctttgaggacagggactatgtcttatcaatcactattattttcctgttacctagcatgggacaagtacacaacacatatttgtgtagtcttctaaaagactcctctgattgggagaccatatctataattgggatgtgaatcatttcttcagtggaataagagcacaacggcacaaccttcaaggacatattatctactatgaacattttactgtgagactctttattttgccttctacttgcgctgaaatgaaaccaaaacaggccgttgggttccacaagtcaatatatgttggatgaggattctgttgccttattgggaactgtgagacttatctggtatgagaagccagtaataaacctttgacctgttttaaccaatgaagattatgaatatgttaatatgatgtaaattgctatttaagtgtaaagcagttctaagttttagtatttgggggattggtttttattatttttttcctttttgaaaaatactgagggatcttttgataaagttagtaatgcatgttagattttagttttgcaagcatgttgtttttcaaatatatcaagtatagaaaaaggtaaaacagttaagaaggaaggcaattatattattcttctgtagttaagcaaacacttgttgagtgcctgctatgtgcacggcatgggcccatatgtgtgaggagcttgtctaattatgtaggaagcaatagatctcggtagttacgtattgggcagatacttactgtatgaatgaaagaacatcacagtaatcacaatatcagagctgagttatccccagtgtagcttcgttggggattccagtttctgggaacgagagttagggccattttatttaaaagaaactcccggttgagaccggt

SEQ ID NO: 88 - DNA, 1048 bp, Homo sapiens
ctcaccgtcgtctacaccgtgttctacgcgctgctcttcgtgttcatctacgtgcagctctggctggtgctgcgttaccgccacaagcggctcagctaccagagcgtcttcctctttctctgcctcttctgggcctcccggcggaccgtcctcttctccttctacttcaaagacttcgtggcggccaattcgctcagccccttcgtcttctggctgctctactgcttccctgtgtgcctgcagtttttcaccctcacgctgatgaacttgtacttcacgcaggtgattttcaaagccaagtcaaaatattctccagaattactcaaataccggttgcccctctacctggcctccctcttcatcagccttgttttcctgttggtgaatttaacctgtgctgtgctggtaaagacgggaaattgggagaggaaggttatcgtctctgtgcgagtggccattaatgacacgctcttcgtgctgtgtgccgtctctctctccatctgtctctacaaaatctctaagatgtccttagccaacatttacttggagtccaagggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggcagatttgaagaatcagctgggagatgctggatacgtattatttggagtggtgttatttgtttgggaactcttacctaccaccttagtcgtttatttcttccgagttagaaatcctacaaaggaccttaccaaccctggaatggtccccagccatggattcagtccccagatcttatttctttgacaaccctcgaagatatgacagtgatgatgaccttgcctggaacattgcccctcagggacttcagggaaggttttgctccagattactatgagttggggacaacaaactaacagcttcctggcagaagcagggacttttgaaagcctcaaagtttgga

SEQ ID NO: 89 - DNA, 804 bp, Homo sapiens
gcccccatcagttcgaatttctgcagtgagagcatctggggttattgtgaccaactgaaagtctcagagagtacccacgtgctccagcccttcctccccagcatccttgatggcttaattcacctagcagcccagttcagctcagaggtcctcaacctggtgatggagaccctgtgcatcgtttgtacagtagaccccgaattcacagcaagcatggaaagcaaaatctgccccttcaccatcgccattttcctaaagtacagtaatgatcccgtcgtcgcctcactggctcaggacatcttcaaggagctgtcccagattgaagcctgtcagggcccaatgcaaatgaggctgattcccactctggtcagcataatgcaggccccagcagacaagattcctgcagggctttgtgcgacagccattgatatcctgacaacagtagtacgaaatacaaagcctcccctttcccagcttctcatctgccaagctttccctgctgtggcacagtgtacccttcacacagatgacaatgccaccatgcagaatggcggagagtgcttgcgggcctatgtgtcagtgaccctggaacaagtagcccagtggcatgatgagcagggccacaatggactgtggtatgtgatgcaagtggtgagccagctcctggacccccgcacctcagagttcactgcggcctttgtgggcgcctttgtttccaccctcatctccaaggcagggcgggaactcggggagaatctagaccagatttcttcgtgccatccttcagttaagatggcaggaggt

SEQ ID NO: 90 - DNA, 581 bp, Homo sapiens
tctttgatcagatttagtgtcttaggtaattaaatcagaaagtctatttagctattctagaagtgtatgtgtaggtattgggtggttggggttctttgagcgaacttgtcagaaactccattcttaacatcagaatcagggcaggattgaaaacattgtggctggatcttgaaattgctataacatctattgcagaaaatgataggtcagatggatagcaataataattatatatcagatcttagtaacaaaattaccaagctttatctagtggatatatgtaaaagaatatttttaaatgtccagcattgatgtattttctttaagaattattacagtatataagcattctttgggaatacagtataaaaacataaattttttcgtatttttaattttttttatttttttggtcaaggatgaatcctcccctgtaaaatattgattttcgcctaaatttcggggtttccctggcacataatagcactggccccaacttcggagatggcggatgcgggtaaaaagccaaaaggatggatggggatccggaaatacgtggtggaatggaagcgaatccaata

SEQ ID NO: 91 - DNA, 2042 bp, Homo sapiens
tggagatattagtcagtttctttagtgatatttgtttccttgatgtgcctttttgtttttctttggggtttttggaatccggatgctgttgaagggcaatagcagactcctccagctaagagacaggacatgttcttgagccactgtagctgttgaagctggacaccagacgctccctataacccccccgccaggccatagcgtgtatgcatgtgcacttccacccacagaggagggtgtgaagccttgagaacctcaagaaagggctggattctgccatacctttgggtctaccttgggactgctggttgccaacgtgtcaaccagcctgtgttccctgccacccacgcacttgctgaggtgtggctgaggcagaatcatgtgaatgggtgcatccaaggagttcagggccctgcttggagaagaaatactttagcatcatgaaagggaaagaacgtgcaccccttttttgtttctttagtgaatgcaagatttaataaaagtgaataatgagcttcccctttgggagtggagcccagtgcagctcactgacagggttgacatcagtatgatgtgttggactgaaactgtatgtctgtaggtaggtgtgtgccttttagggcagaccacggtggccaccccatttctccaaggtggtttacctagcttgtgtatattagacattgccaccctcacctctggccaaaaattcttgatttaaaaagaaaagtctattttgttaacgacaggctctgttgtatgtgttactatcccaagcctggattattttatttatttaaaagtattttaatttccatattggctttattctaatcccatccatccctgtggagctgcagagcatcttcatgtgagtagacggatggacataaatagattcatgctcatttaggaagctgggagtttcgtgaagctgagggtgagttcctgtgattcttgttcgcttcaacaaaaagtgggagaccaagtttttatagcaaaagaccaaattagctgtagagtcttgaatgcagaaaaaaattaccctagctttcttagcacttagggttttgtgaggattcagtgtttagcacagtgcttggcacatagtaagccctagtaaatgttaaatattgttattagtgtttcgtaaaacttgagaaatagagctgagctcattcccttcctgttgattcaaaaataatacctacatgaaaacatgattccaagttgattgaatgttgtaggaattactggtttagagtagcccagttctcggcctaccctgctggttgggatcttactgtattcttgaatgcactggtttgaaaatatgccagacttcagcccccaaggaaacaaggctgcaagaatttatgaactccagctggaaaaggtaaaggtgacctttggctagccacatactggaccttaccccactgacgtctttcagaacattccaagggttttcctcaaggaacatttttgagctagaaattaaaatgggttctctggcagactgcaccccttgagtcaaagttaacagtattcctttgaatgcaataatagaggcttttctgcgttaagggagaaggaatgaccaattgaacttacacattccccaggcaggtccctttgccggcccctacaggctggggtggcccctcctgtcctcagggatcagactcccagactggttagttctgcatgtttccatcaaattaaaggttattccctggccgcctcctggagaaaaccaaccccaccctgccagctgggggcaatggggcagggattttggcctctcagaacagctcctagaggctgctcatgactgaatgttttcccaaatcacctaaatatcggtttgctttttgttttgggggagaggatttagcctcttacttccctgatggattcaaagttttatctatctccttatctcctgccctgtcttggcacaactctggatagattgcaggtgtggaatttgctggagtttggtggctccccaaattccttgatctgtccgcaaagagaag

SEQ ID NO: 92 - DNA, 430 bp, Homo sapiens
gttaaaaacctagtattcatttttttttttcctgtaccaaaacaatcatcttcctttatttttcctggagcgggaagaggagagtggagaagaagggaagaatgcaaagtgtcactttgaacttctcgttcaccacacacgtgggagtccactcatgtcagcagcctccgtgcacaggccccaggtgaaagaaagaatgaggtctagttggaccagctaacactgcctgccttgtgtttacgaaaggcagctgcctctgtggtgtgatttcaggggagccagacagggccggggccacgaacctgcatcctgcatcctaagcacctatttgccatgcggtgaggcttaacttgggaaacttcaatttgcttggggtgcagattagctttccaaactattgtgatgctcatgcttgacttcccaaggactt

SEQ ID NO: 93 - DNA, 592 bp, Homo sapiens
aattaaaataaatagaaacatacggagattcttttatgttggatttattataccctccaccattttggtccctgaaaagggaaaagatacacggtcgagtagtacaggtatgtgtttcccactacacattatggctataatggagttgaattgcaaacagtaaaattttgttttggattggtttcccctgatccccccagacaggagcttcctctcccaccctacctgcctgcccttaagttgtgtcctattaaactggacacaaatctcaccggcttttagtctaataattgaatcatagctacacacggtgacaccagaatagctacttgtttttttatgttaccagtgagtaacttgtttatccttgtatgtagaaactaatttcaccatgatcacagatctgtgtaacatctctagtttgaatttccacacaattttaaaatgtctactaggaaaacttacacctttttgttccaagggtgctcttcatctattaaaaccgtgggggcatacttccagtgttgcttctgagggccaaattttgtgggtcgtgggggacaattttgtattaacatacgttattttgtaa

SEQ ID NO: 94 - DNA, 674 bp, Homo sapiens
aaggccgcgcaagtgcacttgcgtgtcaccgttaccgtagcgactgggcttctggactgtatatcctagctgccttgtcaacatcttcgagcatcggcagctccggaggccggggtaactggcagcaggtaggaaactatgtgaaagaatctcctgatgtcataatttccgggtgtcaccggaacatttgatcatcattcctttggcaattccagccttctgtggaaaggccagtagaaagcattgatttattcacctctacaggaatcagactcagcctcttttggttttcagtgaagtatgccttttcaatttggaacccagccaaggaggtttccagtggaaggaggagattcttcaattgagctggaacctgggctgagctccagtgctgcctgtaatgggaaggagatgtcaccaaccaggcaactccggaggtgccctggaagtcattgcctgacaataactgatgttcccgtcactgtttatgcaacaacgagaaagccacctgcacaaagcagcaaggaaatgcatcctaaatagcaccattaagtcttttgtcaaggtctgactaggtcaagggtaatggaccagtatcatctggtgatctggtaaacaaataaaagtggtggcacctttagatgatgaaaaaaaaaaaaaaaaaaaaaaaaaaa

SEQ ID NO: 95 - DNA, 324 bp, Homo sapiens
gttcttttcattccatcactttaggtgatgggtaagatttttgaaagccttatattttttgattttgttgtctagtttaatcctacctttaatagttgtgtttggtaaaattcccacttgaatgtgacactgataataattatgctgatttttagcatctcttataggaatcaaagtttattaaagttacatagaggattgaaaaatgtatatcactcaatttttatctaaggagggatagggtataaagggaggtacctaaatagctcaaataatggatataatccttttttccataaccatttgggatgctttaaggcaatt

SEQ ID NO: 96 - DNA, 709 bp, Homo sapiens
ggatgcggcactataacatccccgtcagagtgtgtgaggagaccagtctatgagagacgcatgctcctgacagcctggcgacgtggcgaagatgcacaggtggctcctgggcttgggctgcaggtttgggggtctctaagaacaatctctgagaagaacccttgggcccctgggagccaagttggacaggatgtcctgaagactagcttttgataagagaaattaaccaagtctttcccctcatctatgatgcaatatatttcagtgggggccttcagagcacacctgttggacggtgcaaaccatatcttctccagaaggcaaatacttttgtatcagaggaaactcagttttggagaggaatatgttctttatatctcaaatcaaaactctctctaatggtaaactggcttctaatttttttaagtacagtatttttttttcccctttagtagtaacgggtttctatagatcttcctatacagtctgctttaactcaggaccttgagattatgagactgacgtgctgcccactgcactgagggggcttctaacagtctgctttaagtggtataattctgggatagatctgttactggcatagtcatgacaacctctggtaatcttaccttctcctttttatgaagggaagagcaatggtttggacttacatctaaattaaggctattttaagcagattgttttgcaa

SEQ ID NO: 97 - DNA, 562 bp, Homo sapiens
gtccagatggaatgactcccatcctctcctcatctcccctttgacgagcctcaaactgctcagctcatcaaagagccattgccaacttccgtatgtggttctgggtcccagggagccttggaacctggcaccctggggtggtttaattccggcacgagagcattcctgcttctcaagggacacagtggcctgcatgggccagcatggaccctgggctgatcatgtgcattcctgcttctctggggacacagtgggcccacatgggccagcatggaccctgggctagagcaagcacatctccatctcttccacctcaggcagtgtggctccagatgtcaggagggactgacctcaggaccttccaggttcctctgtgccaggaatgagaggccaggcccgatcctaccacctcgccttgaccctgaagtcagagcaggccagccaagcaggaagcacactgtttaattttttgcatggaaagtaaatgtgtactttgatagggttaaaatatggtcttttttaagttgctcaaccccataatttgagccattgccttgcttaa

SEQ ID NO: 98 - DNA, 1948 bp, Homo sapiens
gatcaccaagacacacaaagtagaccttgggctcccagagaagaaaaagaagaagaaagtggtcaaagaaccagagactcgatactcagttttaaacaatgatgattactttgctgatgtttctcctttaagagctacatccccctctaagagtgtggcccatgggcaggcacctgagatgcctctagtgaagaaaaagaagaagaaaaagaagggtgtcagcaccctttgcgaggagcatgtagaacctgagaccacgctgcctgctagacggacagagaagtcacccagcctcaggaagcaggtgtttggccacttggagttcctcagtggggaaaagaaaaataagaagtcacctctagccatgtcccatgcctctggggtgaaaacctccccagaccctagacagggtgaggaggaaaccagagttggcaagaagctcaaaaaacacaagaaggaaaaaaagggggcccaggaccccacagccttctcggtccaggacccttggttctgtgaggccagggaggccagggatgttggggacacttgctcagtggggaagaaggatgaggaacaggcagccttggggcagaaacggaagcggaagagccccagagaacacaatgggaaggtgaagaagaaaaaaaaaatccaccaggagggagatgccctcccaggccactccaagccctccaggtccatggagagcagccctaggaaaggaagtaaaaagaagccagtcaaagttgaggctccggaatacatccccataagtgatgaccctaaggcctccgcaaagaaaaagatgaagtccaaaaagaaggtagagcagccagtcatcgaggagccagctctgaaaaggaagaaaaagaaggagagagagagtggggtagcaggagacccttggaaggaggaaacagacacggacttagaggtggtgttggaaaaaaaaggcaacatggatgaggcgcacatagaccaggtgaggcgaaaggccttgcaagaagagatcgatcgcgagtcaggcaaaacggaagcttctgaaaccaggaagtggacgggaacccagtttggccagtgggatactgctggttttgagaacgaggaccaaaaactgaaatttctcagacttatgggtggcttcaaaaacctgtccccttcgttcagccgccccgccagcacgattgcaaggcccaacatggccctcggcaagaaggcggctgacagcctgcagcagaatctgcagcgggactacgaccgggccatgagctggaagtacagccggggagccggcctcggcttctccaccgcccccaacaagatcttttacattgacaggaacgcttccaagtcagtcaagctggaagattaaactctagagttttgtccccccaaaactgccacaattgctttgattattccatttatgctggagattacaaattttttttgtgaaaaaatcagatcttggtgaggacctcgagcagtaagatataaataactcccataagcttagcgttccagtaatggaacactaggcataaatggtttattcagttgtgcaaatgaaagccatctgacagttggctcacattgaacacctgtggagattaaggacgaggacaactatattgatgggcttggatgaactggggcagggcagctcatatttcgggagccaggagaacgagtgagtgctaaaacctcctgttttctgtgttaaacattccgtccctgtttgagacatcagtatgtacagttaacttttgttgagtgtttagcaggtactagggacatactagtgttttccttaatgtatttaatcttcataattatgaaatgggtgctattattagccccatcttatagatgaggcaactgaggttcagggataaagtaataaaattgcctggggtcacccagccactaaaaaaaaaaaaaaaaaaaa

SEQ ID NO: 99 - DNA, 483 bp, Homo sapiens
aatttatggggtctatctttgaccacgtgataccacttacctgattctatgtactgattaatgtatctaacagttttatagtgaaagtactttttaaaaaagtatttgaatggtcatttctatttttccccctttgctgtacaagttaatttttactcatcttttgctgtacaaattaactttcatcaatacaaataagaggctagttttaagtcaatttatttgtcatgagcccaggaacaattaaattctataaagtaatgtattaaaatagtacactttaaaaattattttccttctttttttctctttaaattttaagaccatcataataaattatcattacaaagtcaaacatactatatactactatcagtcaatggggaaaaaataagtccatatgttttatgggtaaaatgctgtaatagattgggattgtccaatttgccttgaaaaaaatcacagcagtttttaggtttccct

SEQ ID NO: 100 - DNA, 437 bp, Homo sapiens
cccgcttgaggcgtagggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgctgtcatgtatgcagtagcgcttgacctttcgagtgtttgccaataatgcagttcaaccagttggttaaggaagg

SEQ ID NO: 101 - DNA, 359 bp, Homo sapiens
cagatctaggggcttcagctgtgtgcagaccccatgccacttcagggaagtgacacaggcctgtgtcatctcgctttggcagcaggtgggtggccttcctcaggggaggaggtggcctgagatgtgtttcaggtctttgacccatcactccctacacacacgacgtgaacaccactcctggagcattctcagaatggagatttgaattccatgtggcagcttctcacacacaaacctgccatcattccccacacacccactcacgacattcaacagccatgagccaaaagaagttccttgtttcagatttgaaggttttatgaatccacttcttccggatgtagctctttaatgatttt

SEQ ID NO: 102 - DNA, 501 bp, Homo sapiens
tcggcgtcacatcctgagtcgcgcctctgccgaggcggagcggacatgcaggctccccgcggcaccctagtcttcgccctggtgatcgcgctcgttcccgtcggccgggaaccttctagccaaggatctcagagtgctttacagacatatgagctgggaagtgaaaacgtgaaagtccctatttttgaggaagatacaccctctgttatggaaattgaaatggaagagcttgataaatggatgaacagcatgaatagaaatgccgactttgaatgtttacctaccttgaaggaagagaaggaatcaaatcacaacccaagtgacagtgaatcctaaacctgaatggcgctcatgttttccaagagaagcagcccctgagggagtctgctgaggctgccaacagaggatgaagaggatacaaatttaattaatttcaaatcaacatagacacaagaaccttttgctgtttcttccaacgcccactcttcctaatgatggcat

SEQ ID NO: 103 - DNA, 1102 bp, Homo sapiens
cgggatctcccgaaggaatttacggggattcctcggaccattatcctcaggcaagaaacaaaaccaaacttggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaagtcacttcattctggacacagttggatcaatactgattaagtagaaaatccaagctttgcttgagaacttttgtaacgtggagagtaaaaagtatcggttttattctttgctgatgtcctttctgcttgaaataacagtcaccatacagctaaaggagaggagtttctttccttctaagtaggcagaaatggtatcattatgttgccgctctccaatctcccagagctcgctctctagagaatcaccttctttcgcgtttttttttttttttgagggtaggagtctcactatgttgccccaagactaggcctgggaactgttggggggccaaggggattgctcccgtcccgcaggcctcccgagtaggccggga

SEQ ID NO: 104 - DNA, 306 bp, Homo sapiens
gaccaaccttccctgccatttatacggcataaaaccctcaatctcaccagtatggctaccaaaattataggttcacctgaaacaaagtggattgatgcaacttctggaatttacaactcagaaaaatcttcaaatctatctgtaacaactgatttctccgaaagccttcagagttctaatattgaatccaaagaaatcaatggaattcatgatgaaagcaatgcttttgaatcaaaagcatcttgaatccattttttttgaaaaaccttaaaaagggcgatcacaatttttttgaacaagggtcat

SEQ ID NO: 105 - DNA, 2042 bp, Homo sapiens; identical to SEQ ID NO: 91

SEQ ID NO: 106 - DNA, 320 bp, Homo sapiens
aatctttttaccatgaaatttcttccagaattttccccctttgacacaaattccatgcatgtttcaaccttcgagactcagccaaatgtcatttctgtaaaatcttccctgagtcttccaagcagtaatttgccttctcctagagtttacctgccattttgtgcacatttgagttacagtagcatgttattttacaattgtgactctcctgggagtctgggagccatataaagtggtcaatagtgtttgctgccttgagagttgaatgacattttctctctgttttggtattactgtagatttcgatcattctttggtta

SEQ ID NO: 107 - DNA, 506 bp, Homo sapiens
gtcgaacagcaaagccaagacttgttaaaaaggtttgaagaggaaggaccataacaattgaaagggggaaattataagatacagtaaattcctcttcaaagatttagcctgttgacttccttattctttgttctcaaactcgacttccttgttgtccatgcctccttgtccctagttactgtgaacaaccttcccaccagttctaatcaataactcacatctgctcccttggttacccactctgcacccattcttcccactgaaactgcacttcccaccactgtaactcacatcccccttcccttccttatttggaaaagtattcacaaatagccaatcgggtcaacttagaatgagcggtccaaccccagcccctgggggagtgacacagaggtagggactgtgttagggataaaaaccttttcctttctttgttcagtgtgctgctgtgatcatgattgatgcaggcagcagcctttttgcagaagtaaattgccttgctgagg

SEQ ID NO: 108 - DNA, 1276 bp, Homo sapiens
gcgcggccggcgcctgcggggcgagagggtcggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggggaaaccccacccgggaagttgaggcacccttccttccaatttgcctaaccagtttccaggagtggggtgggtttttccgtggcacaggttggggccttagggggggttggacgttccatttt

SEQ ID NO: 109 - DNA, 373 bp, Homo sapiens
aaatacatttatgtttcttgaaatgtgttaagtggcctttgtcaaggtgtttataatagaagagtatataaaaatgaatttctctagagatgcagcatactctaaagatccatcattagataattaaaaatatgtaagtcatgctaacatttccatatataaatggagaacattaactctcctactgtttagttataaaataccaaattttgtaattatcctatctggaattacactatactgcaaaaatgccagttacttcacttttaaatttgacaatgtatgtgatgaattataaaatttaatagcctacatcttttcctccttgtatccaaatttctccggaccttaatgcttaaaccttttggttacc

SEQ ID NO: 110 - DNA, 492 bp, Homo sapiens
gtcttttgaaatctgtttccactacagctatggtcaagtctatcagccggtgctaccaggagtcactgccagggctgccgttctcctgaaccccagtggccagaatcataagccctgaccccatccctagaaagatgaggtcccagcaatggccagagcatttctcaccagttctgtgagatagcacataaaaatagagttctttgggcaaaacttttgggaagcaatgcatcctacatgggctgatattcagcctgagctgttctcaagaggagagtggtactggcagtttatggctgaaatccattctgattggttggagtctatgctataccagttgttaaacattttgagtatcactcttgcatactgttactattatatttcctctatatatagacagaaaggccattttaggaatatttaaagggctcttgaaaattttctggcattagacccaactgaaggttctattaaggcagggttcctaaa

SEQ ID NO: 111 - DNA, 1678 bp, Homo sapiens
gcctcagcagactccttgggcggtagcagggagatggtgcaacggccccagcctgcacaggaaccgagcaggcctggatctgccaaccatagacacgggatatgattcccagccccaggatgtcctgggcatcaggcagctggaaaggcccctgcccctcacctccgtgtgttacccccaggacctccccagacctctcaggtccagggagttccctcagtttgaacctcagaggtatccagcatgtgcacagatgctgcctcccaatctttccccacatgctccatggaactatcattaccattgtcctggaagtcccgatcaccaggtgccatatggccatgactaccctcgagcagcctaccagcaagtgatccagccggctctgcctgggcagcccctgcctggagccagtgtgagaggcctgcaccctgtgcagaaggttatcctgaattatcccagcccctgggaccaagaagagaggcccgcacagagagactgctcctttccggggcttccaaggcaccaggaccagccacatcaccagccacctaatagagctggtgctcctggggagtccttggagtgccctgcagagctgagaccacaggttccccagcctccgtccccagctgctgtgcctagaccccctagcaaccctccagccagaggaactctaaaaacaagcaatttgccagaagaattgcggaaagtctttatcacttattcgatggacacagctatggaggtggtgaaattcgtgaactttttgttggtaaatggcttccaaactgcaattgacatatttgaggatagaatccgaggcattgatatcattaaatggatggagcgctaccttagggataagaccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaagccctctggcccccaggaaacctgttgtgcagagctcttccccggagacctccacacaccctggctttgaagtggagtctgtgactgctctgcattctctgcttttaaaaaaaccattgcaggtgccagtgtcccatatgttcctcctgacagtttgatgtgtccattctgggcctctcagtgcttagcaagtagataatgtaagggatgtggcagcaaatggaaatgactacaaacactctcctatcaatcacttcaggctacttttatgagttagccagatgcttgtgtatcctcagaccaaactgattcatgtacaaataataaaatgtttactcttttgtaaaaaaaaaaa

SEQ ID NO: 112 - DNA, 866 bp, Homo sapiens
gtcgccatgactgccaaggactgctccatcatgattgcactgtctccctgtctgcaggatgccagctctgatcaaaggcctgtggtcccttcatcgaggtccaggtttgccttttccgtgtctgtgctggaccttgacctcaagccctacgagagcattccccatcagtataaactggacggcaagatcgtcaactattattcaaagactgtacgtgccaaagacaacgccgtgatgtcgactcggttcaaggaaagcgaagattgcacattagttctccacaaggtctaactctttccctgcagtgtctttgaaacttgaacataatgtgaaggctgaatgatagagatattttctgttgtgttgggtgacctttggttgtgaatgtttttgcttttaaccccttttgaggtgggattgcctcttggagacatggaattgaagagcactagaaacaacttcctggacaaggaatgtaggaagtgagtgctgtgtcccaggaagctgctcacactcttaaaatggaagtgtccgttaagccctgggaagacgttctggatagttcttctttcccaaccagggctcatgtctgattctctaatgcgaaaagccttattctaagacccaaggtttggatctgctaccaccagactcctaacatagaaaacttgaattgtcacatacattttacagtttggacttttaagaaaacatggatactactgggaacttcccccagctgagttacatgggcactttttcagtgcaagccacatatcaacacagggttttaaggtgggtgcctggctgcacacgtgaaccccgtggccccccagatgccgattctgagccagtgtagacccagg

SEQ ID NO: 113 - DNA, 1434 bp, Homo sapiens
gcgcggccggcgcctgcggggcgagagggtcggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatgtggaatcaagacaatgcccaaaaaatttttaatgcagctggtc

SEQ ID NO: 114 - DNA, 914 bp, Homo sapiens
ttggcagcggggagagggaaagaggaggaaatggggtttgaggaccatggcttacctttcctgcctttgacccatcacaccccatttcctcctctttccctctccccgctgccaaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttggttggtttggtttaaaatcaagcctgaggctgggtggaaacaggtagcctacacaccccaaattgggggtggtcccgggggaatgtt

SEQ ID NO: 115 - DNA, 685 bp, Homo sapiens
gaaaatccaggggtgaagaatagatctgtggtggcaggggtgggaaaggcggggaggatttgcctactgaggggcagcacaagagaattttgcggggcgatggatctgtctgtatcttgaccatagtgatgatacatgactgtgcatttgtcagaactcacaggactgaatgaaaagagaagtgaattttactgcatgtgaattgttaaaataaatgctagacagtattttaaaaatcaagcccagatcctgcaagacattatggctccccaccagaaggggagagacggggaaagagaagtgtccccaaagttaacccacgttccctgggacccacctccctccccactgccacttcccaccagcctcacgcacgggccaggcccttccctttgcagctcacagcccagcagatgttaggtcagaatgcgtcccctcacttgactaaaggtttacagccagcagggtgggaaatgaaccagatattaacaccccctcctccatgccctgcccaccttctgggccagtaccagtgaaggcaggaagccacttctcccacccccaggctgttcccaaagccctggaagaacccaaggaaaggcaggagccaagttgggagttgaccttgatgaccaggggccagttggcccagtttcccttgtttagttggggggagggaaccctt

SEQ ID NO: 116 - DNA, 2646 bp, Homo sapiens
ttaatttaatagctttcatgtgattaaaaatagctaactagactcaaggattcacaatatttaggtgtattttcaatacctccagaaaggaaacctcagttaatcagaggaaatagtttcagtcttcatttgagcatgtctttccatctcaaaaaaatactcttagtaggttggagtgaagatagcaaggttttgaagcatatttgtcctaatccacagtgacactttttatcttccaggagcactcctaggaggttccgtgcctaatcaatgttgactgctttgcagatctcaagggaataaaatgacaaaagcagggaaagttacagattcaaacagcattttaactcatgttgatctggataattaatcttttctaaagatgtgtagtttcttggaaaacagtgatatcacatgattaaaattacatttttatcaacataattgtctggaaaagataagcccctcaattttctaccagttgacttttattcattagatacagaaggtgcagtattacacatcaccagctgcctttgtgaatggctcactacacagccattggggtacaactgtgtgcatgggcagaaacagcaagtgccctcattgtggtcattgggtggggagtgccttttgtcaaggagtctgcaggaattggcttatttctgtatgccaaagtgatcaacacaccaaagtctctgccataaagaatgtggcttccttgcatcctccatcctgttactctgggcccagtaatttgatgtaactgtctgattgtactagagacaggagtatacccagcttattcataatcaagtaaagagactcagattagatttgattttttagcctcctctagagccaatcaggcagttaagagtaataaaggaaaagggtttggtcacaaaccctaccattatctggagattacttcctgctgcactcctgtcttgccatgcacgtcttgccccctcacttttgctcagcctagcagtctacttcactttattgccttgtaagtgtcaggcctcctgggcgctctggaaaagacagggagccaggccctctcacccctactggtaacaggtcattgctgggtgcacaagagggaggtgatttgcatcatggtcatgctgcatgggcttcactgggatgctgttaaacaccagaggagccaacctatcagaatcccagcagcaaaggaaaactcagattttagaggctttttacaataaagtagcgtaactctaggtcatgattgatttcaaatgcctgccatgaatgatttgtaagtaattatgtaggatccatcaaagcagtattgtaggcttttgaattgtcccagtggatccgggaccccatttcactgtctctcttgatcgtgttaatgatgcaatcagagttcaagacaggccccatgaagtctgactgcactgggatggagaaatgaatttcttcccactgaaggaaactctttctcattcgcagccaagacgggagtgccactgttcctctcttcactcctgagatactgcttctggaagcgggtgtcacttcctctctagtacctcttctcttctctgaagtgtgtgactatctcctagtgtttaaatttggcagttactcgccatgtatgtcagcatagaaaaggaaatgtttttaccttatctcctgtatgtatgatagaacttaaaagaaatgtgcatttgttttcatagccccagcagagaaaatcctcttcatagattaaatgtgctgctgtggacaggagggaaaaaaaaaccctctacatattgaaaggcaccaaatgtaatatctgacactgttaagatgcccaaaagagcaaagttgtagtggagatgcagggtcatttccccatgccatccacagtgtttgttagtgagtccacggctgacttgcagtgataaagaaaagcatggagctgtgtctgcagacaatggtggctgcatctgtaagtggcttcagaggcagcagccctggggaaattgatgggtgtggcagtggacctgtgaagagggagaatctagccttcagcctgtccagtgttaaccactagagaaactgagctttatatccttttttaatgcctgtgaattttagcatattgaaacattagagcaaatactcaggggatttttcattaaacatccctcagataatttagctatatatcattagaaagggaaagctatcatttttattttaaaactaaacaaggccatcttataaactgtcaccaaagtcttcccttttttattgcatgtgtgccttgaatttcataaaacattaattcacaatgggggtcagaatgtactcttgttgaaacacttcttgtaccattttatgttcatattatgtttgagagggtaaaaatgtatgagcagcttaactgaagtagaactattcatgatgcttttcacacattgtggcataagatgtaaagtttgtaattaatgttaatttctgtgcattttaatattcttttataattattaatgttaatttctgtgcattttaatattcttttataattatgagcattttaataaattcatttttacaaacaataaaaaaaaaaaaaaaaaaggaggaagggaaaaggaagaaggaggggggaagaggaag

SEQ ID NO: 117 - DNA, 2667 bp, Homo sapiens
ttatcttggaagtctgtgtatcaaaatgaagaattcagatggtaggaggttctatagtccttttaaagctgactcttgagtgtcagttgaatatccattaaattggatttggaaataacctgaggaaagtattatgaattcgatctgcacagatgcctcttagctgataggtggcaggcctgtgggtttgggttctccctcttttctctggaacatatgacaattccagattaaagaaaaatgttttttaataaatacccttggtctttcttctagtcacctttgaggtagatattgtgattttctggagtatagtatatccgtgtctctgtgtcttaggtttactagatgcaataatacttctctttgacatttgtactgaagtgatttgatattaagtaaaacagttaatgtttgaatataggcatatttataggttttttccgctcccccccaacccaccctttttaaaaaatctatacaaagcccttgtttgagtctcatcatgcacatcaaatcatggagttaggtcttctctgagctcaggggaacacaagtgcacagagagagatgtcttgagggtcactaccaaagaattaccctcattgtccctcactcaggccatgtgtacatgcgatgctgctgagtgtgctggggtgggtggtggccacgtggctcccccagagcacttcctaactggcaagctgggagacccattactggtgaactttgtggaaattagaactgtatcttttacataatcttggcatattacatttcataataaaaacatacatttagttgcatgctacatcactattgattttataattaatttcttaagcttcaaccatgttttataccttatttcgttacatcatatatttgtaatgtgtaatatgaaatcttttgctttaatgtctttttttaaaatgtagaatgttctaaacttgaaaggcaattgaatgtagtatgatgaaaatgtgaatgttttgctgctttcatgaccaaagatacagggctagtggacatttagaataataattaaagctagagtcttgtatgtcttttctttgaaggagttctaaccttgtaaattgagaatgacttcagagaattttgattaagaaaacattaaaatcttaaccggcacaaacactccaatttttttcactgtgaagccgcaagcaattttttttctttttctttcaaaagcctgccttctgaatttatttcttgtttactcatttcagagagggtagtaaagaagatctatttctggtagtcatatcgcttgaaaggtattggtaaatgtgttttcagtcgtgaccatgtggaaagtgaacagtgttggcaaacattaccgagaaaatcatgcttttcaagatgcccttgctttgggatatccttcctagggagaaaaaaaaaaagtagtttaacaattgtgaattccatttcttatttcagtttctgctgcagtaatgggttcccacccactataattcccagcatttatgttctgttgtattctccccttagcccagtaacatttttatctaataccccattccccaagttttgagacagattgaccccctactcattatgtggctctagttgaattttaaaatgtggaatattgggcttgcaggcagtaggagctgcaaatctggtagagtgggagtgtggagttaatggtgagtatgttaataaagggaaactgtctctgacagaatctcagtaatgtttaccaaaacatgtctttctacagctggtaggataaatgatgctaccctgtagctcagctacaggctgcagtgcaaacttttcttccatccagagaaagcagaattccctcctagtaacctcattacaaatactgttactagaagggcatgtgctgtctgtcaccttcagtaatatttgtgccatctcttgatgactgatgacctggatcgagtatttctatgaagggtcttcttaggccccttacatacgcaagaggggtgctctagtgccatagctgtagttcacaggaaggacaccaggagaagttatacctagggctactgagcagctcatcatccctgtttctgcacagtttcctgaaactggccatcagggcctctgaggcactcaaatcagtttacttttagcatgcccccatcagggtgggtctcactgttagtgaggatacgggtctggtttgatgtttttctaggcaaaatgcttaagtgttctggttatgccattcattcatacgatgtgtgaaatttgcttaaaagggaattttcatgatttgatttagattagtatttaaatatctgctttagatagcaattaattttattgtaaaaataaggaaaaatatgtgaatatgtgaattttttaagcctgagagatgatagaatgttcccatatttttcttgtaaagaaaataatattttaacttacacatcctgtagaaaataccaccttttccccttgtattacagtacaatgtttacattactatactgtcaagctgaaagtataaaaaatgtacatatacattttgagttatgtatcctttttttaaaaaaaggtgcggggctgtggcactgggctggacatgactaaagttgacagaggctatgctagatttataatcactagttctgggacttg

SEQ ID NO: 118 - DNA, 544 bp, Homo sapiens
catctgtgcatggatgagtggccgactttggagcccaggctgttacttcctggtctggtggtgaatcctccatagtctgagagtaagatccttgatactggctcagcatggaacatctggcacacagtatgcactgaggaaatacttgttggaataatcagtgaatcatagatgaaaacttaaccttggaattaattatgagactgctcagaggaagagaatgggagacaaaggacctggtgattagacccccaagacactgggctgtctgcttgtgtctcgggtggaacaggcccagcgagagtctttagggccagaactcaaggaatttattgagccatggcaaacaggcagtaaacagcccattctggctgctgtattgagaagagaatgtggtggacagatatagaagcatggaaacctgatagggctattgcaatcactcagaaaagaggcgatggcagcttggacctgttgaagcagtagagtgctttccagggaggagaaaggacctgaaggttaatttgatcaccatgggccatga

SEQ ID NO: 119 - DNA, 1340 bp, Homo sapiens
gtttgatactttcctgcacttaggtttgtcctattcttcatttattcagactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttaaaaaaaaaaaaaaa

SEQ ID NO: 120 - DNA, 2376 bp, Homo sapiens
ggatatgaataaattgttaatataaagtcctacagaaattaatttatgaaatttctctaaatcacacaaaacttaaatacagatgactactaccctgagactgaaaaatatgttctaatttatagtgctatttttgggcagttttggtgtcagaatacctatcaacacattctttttttattaggaaaaaaaggatgtctacataacaatttgtaaagtgataaaatccattagtttttaagtcttctgatagcattggctattataagaaacaagtatttgctctcgtttttaacgggataataatgctatgtctacataaaatgatttctaccaccttaaatagctcactgtagaaattcatgtataaatggaaccatatagtacatacatatcatactcttaggtctggcaaatatttgaggttcatccatattttatattcactcatcagtagttgtaaacacattcttaaagtagcattttcagatatgaataagcagggatgaaataagtattagggtaagggaaatggttgaggctttcctaagtgaagtgtaaaaaccacagctttctttttaatgggatgtctaatatgcatttatctgttcaagcattttaagatttccatgaaaatgtcctgaaaaatcaagattcttcattgagggtgaggatctcccaatgggagactgctctgaaaagagcatgtgctttttgaattagataacctactataatcatggatgttcttgaatacttagcaaacataccagcatcccaaagtcaccaagataaaccctcctactccaacatcacatgatcttctaattctacctgtaaaaataagcataacaattaattagaatataattacgttatatacattactccacctagaaaaaaaaatagttcattatgtagagaaatgctttttttagtacatagagaaataaaaaatacagatactcactagtgaacaaaaaatgtccaaagccagccacaacagatcctaatgaaccatacaatattgaatgccgggcgcagggagtattttcaacatctaaaaatcctaggagcttaagggactagaatgaaaaaaaagaacctagattgagtaagaaagtatttcattttggggtgctttggcaaaaatgacaatacaccatttcttttcttgtagttgagggtttaaactagagtatgtgccacgtgacaacctaaatcagcttgcgttgtctttgtccacctttggtatgcagtctgaatctttaaatccgaaaaccttacaaattggaccggaaaacccttaagcagtagggtaacttggagctgtatcttaatttgctaatcaactgacttggaaataggataattcattttatgagctctttaaatgagtttatttgggaatatgcctatcattggaattgaaagcagcatagcttgcttcagtaactccaataatttgggaagcagaaatggaaaaagtaatttgagtcatgtttgcttatgtagtgccgtttaaaattcccctagtaattacctttcatattttattaactaggttaacatcaactgtggttgtaagagtaaatgtttcaccttaagataaacatgggcaatatattaaactctagtctgttttcttgcctgtgaagtgaggctgcacttgattatatttgattctttgttcgtaatacatgggaacgacagctaagtgtggtgaaaaacgcggggatccaaagagctggatttttatctcagatctgccgctaacttttgtatcctataggctacttttatttctatggtctcaatctataacatgaatgggttgggttaaatgactgaagttccttcaagtgctaaaattctttttctacagtcttcattggatttatgtatttcttattcctaatatgtttaactgggatgtctgtcactctagggcggcaagacagacatttaaaagtaacagtcacactgctgaactggcatttctgttaacacaaaagtttagaaaactcacggtaactgttacttgatttaagtgtatataaaattttcagtaaggctgcttttaaaaggaaccactgtccatttaaaggtttcatagttatcttcaatgggttagtattgtttggggcaggacattaaactagaagggattctataggatgaggtgatacctagaaggtaatatattgtaaggcaaaagagattagaagaaatggggggaaaggatagtaaaaggcaagtcagattaaagggttgaaacatgaagatatccccattgtattccggccccatgtttgccctttttggctccagcatcgtgtttggaagaggccaatgtgccctgggtccctaataaag

SEQ ID NO: 121 - DNA, 225 bp, Homo sapiens
cagttgtgaagttttgtaaaatggtcacccaacttaaaactaggaaattacgaagaagagaaaattgcccggtatctgttaaggtctgcctgtagatctgctgtagggcttgtcaccattggaagcaaggtcctacttcagtggcagatcttgtggcctttgagtggctgaagaccaccaccctgcacagggctggggccatgcacaggcatccttccctacctt

SEQ ID NO: 122 - DNA, 1967 bp, Homo sapiens
acgggcggcgcccgcgctcgcaggccactctctgctgtcgcccgtcccgcgcgctcctccgacccgctccgctccgctccgctcggccccgcgccgcccgtcaacatgatccgctgcggcctggcctgcgagcgctgccgctggatcctgcccctgctcctactcagcgccatcgccttcgacatcatcgcgctggccggccgcggctggttgcagtctagcgaccacggccagacgtcctcgctgtggtggaaatgctcccaagagggcggcggcagcgggtcctacgaggagggctgtcagagcctcatggagtacgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccgtgctgtcacttacatctataactgggcctacggctttgggtgggcagccacgattatcctgatcggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcattttagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcttgtcacaaaagtgccactaaaacagcctcaggagaataaatgacttgcttttctaaatctcaggtttatctgggctctatcatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattctaaacttgaaaaaaaaaaaagtcgacgc

SEQ ID NO: 123 - DNA, 612 bp, Homo sapiens
cctagctgtccccctgagatgaagaaagagctccctgttgacagctgcctgccccgctcactcgagcttcaccctcagaagatggatcccaagagacagcacattcagctcctgagcagcctgactgagtgcctgacggtggaccccctcagtgccagcgtctggaggcagctgtaccctaagcacctgtcacagtccagccttctgctggagcacttgctcagctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgttgctgctggtcttcgctgtaggcttcctgtgccatgacctccggtcacacagctccttccaggcctcccttactggccggttgcttcgatcatctggcttcttacctgctagccaacaagcgtgttccaagtttactcctacagtctgcaaggttacaggttggttgggggagaaatgccgttttggggttcca

SEQ ID NO: 124 - DNA, 1183 bp, Homo sapiens
tttcggcacagcatgaatggctgcgagaaggacagctcgtccacagattctgctaacgaaaaaccagcccttatccctcgtgagaaaaagatctcgatacttgaggaaccttcaaaggcacttcgtggggtcacaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcaggcacgctgcaggacacctcgggagggccaggggcctttccggggttagttttcggttaggggttttcacagttgcatttttttgcccccacggaggattaggaagtttttccacagatggcaggcattttttttgagttccccggtttttgacgttttggttg

SEQ ID NO: 125 - DNA, 891 bp, Homo sapiens
cggaggcagcggaaagccgagccaggcgcctgcgcgctgggaagagtaggttcagagtgcattccggaacccggggcgcggcgcactgcgcaggcggccggactccgctcagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaactttcaaacatctgatggctttacaggggctgaatataaaagcatttgtacttaaaggtcttgtgtattcattaagaaatatagtaatgtcttttaatgttttaagagttgatcaggggtttactatggattgcaagtaatagggatgattaataaggggaaggtttttatggaatttcaaaagtcaatttatttcaaaagcgggggaaagggttttgagaggaggggggcccaaggtgttcctggggtttgccgagggaggc

SEQ ID NO: 126 - DNA, 482 bp, Homo sapiens
tctctaaatagtaccttttcagtcttgccccagaagttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcaggggaagaagaggtgaaggtttcgaccatgccactgtcaacctcttcccattcattacaacaaggacagcagcctacaagtctccacactactgtggcctgacaacagaactgagaggagaggattagactctggggtgcttgcatgggcaactggatttttgcatgattcctttatgattttgcttttaatgtatacacccagaagagccaatataaacgttcctcatgcctaaaaaaaaaaaa

SEQ ID NO: 127 - DNA, 610 bp, Homo sapiens
ctcgagccgtgggcagtggccgcgaatgcgcggagacactgaccttcagcgcctcggctccagcgccatggcgccctccaggaagttcttcgttgggggaaactggaagatgaacgggcggaagcagagtctgggggagctcatcggcactctgaacgcggccaaggtgccggccgacaccgaggtggtttgtgctccccctactgcctatatcgacttcgcccggcagaagctagatcccaagattgctgtggctgcgcagaactgctacaaagtgactaatggggcttttactggggagatcagccctggcatgatcaaagactgcggagccacgtgggtggtcctggggcactcagagagaaggcatgtctttggggagtcagatgagctgattgggcagaaagtggcccatgctctggcagagggactcggagtaatcgcctgcattggggagaagcttagatgaaagggaagctggcatcactgagaaggttgttttcgagcagacagagggtcatcgcagataacgtgaaggactgtggcaaggtcgtcctggcctatgagcctttttttgggccatttggtgcctggcaaggccttcaaacag

SEQ ID NO: 128 - DNA, 2072 bp, Homo sapiens
gggtcatgtaggtacaacagcaaccaagaagatcgatgtctacctgccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggcccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagcccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaaggggccacattccccattcctcttctccttacagcgcctgcctcctttttaagcaggcggaaagctgctgtttctcacgtttcagggagaggggtgaccaggagactgtgtcgtgcgtcggtcctgggtggacag

SEQ ID NO: 129 - DNA, 980 bp, Homo sapiens
tttatggagttagagcaggggaacttaaaaacaaaagtgtatttaataacttcatgagactgtgataaccagtttatatttgaaatatatacagcactttgggagactgagggttgaccctgatagtcctttgcacagtgatcttcagatcttaaaagaaaaagaaggcatagaatatattttgcttaacttctcttttaaggataactttccatttgatcctccatttgttcgagtggtgttacctgttctctcaggagggtatgtattgggtggaggagcattatgtatggaacttctcacaaaacagggctggagcagtgcctactcaatagaatcggtcatcatgcaaataaatgccaccttagtcaaaggcaaagccagagtgcagtttggagcaaataagaatcaatataatctagcaagagcccaacaatcctataattccattgtacagatacatgagaaaaatggctggtacacccctccaaaggaagatggctaaatatgttgactgttgtatgtttggactaatgttgctttaaagaaaatctttccaacatgcagacaaaagctttgagtgcccctattacagcagtaccgaagatgttagttaatagatattttagtggataatctgtcatctgacatccagtataagttacagccttcgcattttgctcattttagatatcttggactgagcagtggggcctttactgtatttttcctgataaatacacatactggccactccttatctctttttcttgaaaagtgaactttttaaaggcagccaagtcaacatcagggctactgaagttggagggctttaggggtaactttcctatattgagcccatggggttacaagggtttggcaatatattgttcccttttacagccaatacaggttttaatcggatgtttcaatattgggtttaggggattttaagggccctcttaagtcataatagccct

SEQ ID NO: 130 - DNA, 792 bp, Homo sapiens
ctgtttggcagggcggggcgcctcgcgaagatggtggcgcgcgcggcgtgtggctcccgtcgtctggccaagtctcagcgcacgcaaccggccggcgtctcgttggcctggagcccacacccaccgggtccctgaccccgcgccccccgcgcccggttcccggcatgcctcgcgcccgtaagggaaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttgggggggatgtcgtggatgagcaagggccagcaggaagaccttgaggaaaagctgaaggagtatgtggactgtctcacagacaagagtgccaagacccggcaggtgcctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccacgtgagttgcctgtgccccatgaaacccttcctgcaacttatccctcagcagagtggtgggttccccctatcttcagcctcc

SEQ ID NO: 131 - DNA, 1092 bp, Homo sapiens
gtgggtccccccggttccggcgcggttgaggccttcggtggtgaacgagtctccagcaccatgtctggtttgtctggcccaccagcccggcgcggcccttttccgttagcgttgctgcttttgttcctgctcggccccagattggtccttgccatctccttccatctgcccattaactctcgcaagtgcctccgtgaggagattcacaaggacctgctagtgactggcgcgtacgagatctccgaccagtctgggggcgctggcggcctgcgcagcacctcaagatcacagattctgctggccatattctctactccaaagaggatgcaaccaaggggaaatttgcctttaccactgaagattatgacatgtttgaagtgtgttttgagagcaagggaacagggcggatacctgaccaactcgtgatcctagacatgaagcatggagtggaggcgaaaaattacgaagagattgcaaaagttgagaagctcaaaccattagaggtagagctgcgacgcctagaagacctttcagaatctattgttaatgattttgcctacatgaagaagagagaagaggagatgcgtgataccaacgagtcaacaaacactcgggtcctatacttcagcatcttttcaatgttctgtctcattggactagctacctggcaggtcttctacctgcgacgcttcttcaaggccaagaaattgattgagtaatgaatgaggcatattctcctcccaccttgtacctcagccagcagaacatcgctgggacgtgcctggcctaaggcatcctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaatagggggttacctagataatgccaaagtcagcatttgtcccgggtccccttgtgggagctgtgggacgatgttttcttttctgccccttttccggagcgtggggggccaaata

SEQ ID NO: 132 - DNA, 1523 bp, Homo sapiens
ctcatgtctaaagaaattcctttttgtgtgaaaaagactaagagcatcttcaacagtgccatgcaagagatggaggtttacgtggagaacatccgcagaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttccagggataagagcacagcttcaccagccatccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggaggactgccccggccgtgcagcgggtccgtgtggaactcatcaagtaaagtttcaaacgtcct

SEQ ID NO: 133 - DNA, 2241 bp, Homo sapiens
cgccgcccaagcgccagaagccgagctgggaaaagggaggcagaggaggcggaggcagaggcagaggcagagcccggtgccgagaccaagcgacagaccggcggggctgggcctcgcaaagccggctcggcgagctctcccgacacccgagccggggaggaaaagcagcgactcctcgctcgcatccccgggagccgcactccagactggcccggtagtcaggggctcaggagcagatcccgaggcaggctttgctcagcctccgacgagggctggccctttggaaggcgccttcaacagccggaccagacaggccaccatgaccgagaattccacgtccgcccctgcggccaagcccaagcgggccaaggcctccaagaagtccacagaccaccccaagtattcagacatgatcgtggctgccatccaggccgagaagaaccgcgctggctcctcgcgccagtccattcagaagtatatcaagagccactacaaggtgggtgagaacgctgactcgcagatcaagttgtccatcaagcgcctggtcaccaccggtgtcctcaagcagaccaaaggggtgggggcctcggggtccttccggctagccaagagcgacgaacccaagaagtcagtggccttcaagaagaccaagaaggaaatcaagaaggtagccacgccaaagaaggcatccaagcccaagaaggctgcctccaaagccccaaccaagaaacccaaagccaccccggtcaagaaggccaagaagaagctggctgccacgcccaagaaagccaaaaaacccaagactgtcaaagccaagccggtcaaggcatccaagcccaaaaaggccaaaccagtgaaacccaaagcaaagtccagtgccaagagggccggcaagaagaagtgacaatgaagtcttttcttgcggacactccctcctgtctcctattttctgtaaataattttctccttttttctctcttgatgctcaccaccaccttttgcccccttctgttctgactttataagagacaggatttggattcttcagaaattacagaataattcatttttccttaaccagttgtgcaaggacagcaacaaccaatctaatgatgagaatgtacttatattttgttttgctattaacctacttacggggttagggatttgcgggggggcttgtgtgttttgttggcttgtttgccatgaaggtagatgtgggtggggagaagacacaaggcagtttgttctggctagatgagagggaacccaggaattgtgaggttagcaggaatatctttagggtgagtgagttttccttgagttgggcacccgttgtgagagtttcagaacctttggccagcaggagagaggtggtagggagcagccagccggcaaaggaaggaggtggaaaaaaaccgccaccgggctgacttccacctcccagtggtgagcagtgggggcccaaacccagtttccttctcatttttgttagtttgccctttcggcctccctattttcttagggaaggggagtggggtccaagtgacagctggatgggagaagccatagtttctcccagtcagctaggatgtagccattgggggatctttgtggcttcagcaaattctcttgttaaaccggagtgaaaacttcaggggaagggtggggagtcagccaagtgcctcagtgtgccctgttgaaacttaggtttttccacgcaatcgatggattgtgtcctaggaagacttttcttttcctctggatttttgttcctcctgtacaagaggtgtctttgcttggtttggtggggctgcggccacttaaaacctcccgatctctttttgagtcctttattataagtagttgtagctgcgggagggggagggggagtgggcgggcagtggatagtaagacttactgcagtcgatttgggatttgctaagtagttttacagagctagatctgtgtgcatgtgtgtgtttgtgtatatatacatatctagggctagtacttagtttcacacccgggagctgggagaaaaaacctgtacagttgtctttctcttatttttaataaaatagaaaaatcgcgcacttgcgcgtcccccccccacccccttttttaaacaagtgttacttgtgccgggaaaattttgctgtctttgtaattttaaaactttaaaataaattggaaaagggagaaactgaaaaaaaaaaaaaaaaaaaaaaaaaaaaaaaa

SEQ ID NO: 134 - DNA, 631 bp, Homo sapiens
tgacaatggcttctttaaaatactcagaggacaggatcacggtggaatcgaatcagaagtggtggctggaattccacgcaccgatcagtactgggaaaagatctaatctgccgtgggcctgtcgtgccagtcctgggggcgagatgggggtagaaatgcatgtgatgcgttaagttcacgtaagatacaagtttcagacagggtcggaaggactggattggccaaacatcagacctgtcttccaaggagaccaagtcctggctacatcccagcctgtggttacagtgcagacaggccatgtgagccaccgctgccagcacagagcgtccttccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagatggtgttgggagccctttggagaacgccagtctcccaggccccctgcatctatcgagtttgcaatgtcaaacctctctgatcttgtgtcagatgattcttaataggagtttatttttcgggcagctgcgaatcaggggggtaaccagg

SEQ ID NO: 135 - DNA, 980 bp, Homo sapiens
ggggccgggagggtacttagggccggggctggcccaggctacggcggctgcagggctccggcaaccgctccggcaacgccaaccgctccgctgcgcgcaggctgggctgcaggctctcggctgcagcgctgggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacctgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctgggtacagcccgacctacaaacaggacaagcactacggatacaattctacagcgtctccaatagcgagaaggacatcatggccgagatctacaaaaacggccccgtggagggaggttctctgtgtattcggacttctgcctagagtcagggggtacaaaagtcccgggaatttggggggccgcc

SEQ ID NO: 136 - DNA, 2238 bp, Homo sapiens
cacatgttcggggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtagaaaaatttgcccatgaagggctgttctttcccctttcctttattagtaaatgaatttatttttcgttcttttggtcttactctccattctactgctgctgtaaatccctagtttagtgactagaaaaatacccttaagattcatattttca

SEQ ID NO: 137 - DNA, 398 bp, Homo sapiens
tgcagattggttggggcagcccggggaggctggctccgacacacgactgagtgtgcctacactggtcccacaggttttcagctgtggagtttgggatctgagcttggagcccatttgtttctggcagttccgctcatattttccacttgaagacatcgcctccgttccttccaagctgggagaccagaagtcaacaacaggagggtggagaggccgggtctcacaatccgcttggctggggagtccactgaggttcttgcatcctgaagcaaaccatggagagctggtggggacttccctgttttgcgttcctgtgttttctaatgcacgcccgaggtcaaagagactttgattttggcagatgcccttgatgaccctgaaacccaccaagaagccaa

SEQ ID NO: 138 - DNA, 1084 bp, Homo sapiens
ggcggtggcggaagtgggagcgggcctggagtcttggccataaagcctgaggcggcggcacggcggagttggcggcttggagagctcgggagagttccctggaaccagaacttggaccttctcgcttctgtcctccgtttagtctcctcctcggcgggagcctcgcgacggcccggcccggagcccccagcgcaggcccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatattctctcacacacacacacacacggcacacacacacacacaggtttggacgttattcagattgcggcctttgccgtgttgggttcgtggggg

SEQ ID NO: 139 - DNA, 1259 bp, Homo sapiens
taaaatacagaagaagagtccacacactgtttcacgagaaggagtgtatcatgatttgtagtaatcgaagaacatgtttatgggaacagggtgactcagctctcctggggaggatggatgaggagttagcaggaagagagggtaccaagtgaggggaaagcagcagggtgggtctggggcatggacaggaagcagaggctgggaaaagctacatcttttattcatgctttttcacaggagctgaagtgggaatcagtacatcgagaatccacggccggggaccagtaggacttgagggactgcttactactaagtggctgctgcgagggaaggaccacgtggtctcagatttctcagagcatggaagtttaaaatatcttcatgagaacctccctattcctcagagaaacaccaactgaaaagagccaggaaaacccgggaattttccaaaaggtcttcacgttaaacttgtcttatctcaggagagagcccgctcttgtctcccagttcctggtagggtctgcctgttggaaagtgtacctggatgcttctgggctccgtttggcaatagcaatcttggctgatgtgcacagtctggctcccagctcaccctttttttttaaaagtaagaaaatagttgctaccgatagggactttgccaagtccaattatcttctaggattgaaaggtgcattttccccataaaaaaggcgaggaaaacccatggctgctttgtgtcacctcagtgacttacagtcccccttggcatttagttggtactagagccagtcatccttaacaaatcttttcacattttatttctttcacatgtagtcatcttcaaaaaggaaagatttggaattttagaaaaggggcaactcttctttttagcattctcatcagaaagtcacaaaaatcgatggaatcatttccactgggaagattgaccttttgtatttatttgtggggtaaattaataagcattccagatgcttgcagcttcctgcatccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttggattcttcccccttttttgagaaataaagttttttatgaaaagccaaaaaaaaaaaaaaa

SEQ ID NO: 140 - DNA, 1938 bp, Homo sapiens
ccaagatggcggcacgatgcctgcccggctgttggggtggcggtgacgacaggcagcaaaagaccagctggtcccagattcgctgctggagtgctggatggagcctttctctgccctctgtgacatttccaattttagataatgcctcacatctctgtccccccgggaccccctggagcccccatgatccctaagaagacagcttgaacctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgcaaaaaaaaaaaaaaaaaaaaaaaa

SEQ ID NO: 141 - DNA, 1874 bp, Homo sapiens
caaaaaaacctcttaatattctggagtcatcattcccttcgacagcattttcctctgctttgaaagccccagaaatcagtgttggccatgatgacaactacagaaaaaccagaggcagcttctttgccaagacctttcaaagccattttaggctgttaggggcagtggaggtagaatgactccttgggtattagagtttcaaccatgaagtctctaacaatgtattttcttcacctctgctactcaagtagcatttactgtgtctttggtttgtgctaggcccccgggtgtgaagcacagaccccttccaggggtttacagtctatttgagactcctcagttcttgccacttttttttttaatctccaccagtcatttttcagaccttttaactcctcaattccaacactgatttccccttttgcattctccctccttcccttccttgtagccttttgactttcattggaaattaggatgtaaatctgctcaggagacctggaggagcagaggataattagcatctcaggttaagtgtgagtaatctgagaaacaatgactaattcttgcatattttgtaacttccatgtgagggttttcagcattgatatttgtgcattttctaaacagagatgaggtggtatcttcacgtagaacattggtattcgcttgagaaaaaaagaatagttgaacctatttctctttctttacaagatgggtccaggattcctcttttctctgccataaatgattaattaaatagcttttgtgtcttacattggtagccagccagccaaggctctgtttatgcttttggggggcatatattgggttccattctcacctatccacacaacatatccgtatatatcccctctactcttacttcccccaaatttaaagaagtatgggaaatgagaggcatttcccccaccccatttctctcctcacacacagactcatattactggtaggaacttgagaactttatttccaagttgttcaaacatttaccaatcatattaatacaatgatgctatttgcaattcctgctcctaggggaggggagataagaaaccctcactctctacaggtttgggtacaagtggcaacctgcttccatggccgtgtagaagcatggtgccctggcttctctgaggaagctggggttcatgacaatggcagatgtaaagttattcttgaagtcagattgaggctgggagacagccgtagtagatgttctactttgttctgctgttctctagaaagaatatttggttttcctgtataggaatgagattaattcctttccaggtattttataattctgggaagcaaaacccatgcctccccctagccatttttactgttatcctatttagatggccatgaagaggatgctgtgaaattcccaacaaacattgatgctgacagtcatgcagtctgggagtggggaagtgatcttttgttcccatcctcttcttttagcagtaaaatagctgagggaaaagggagggaaaaggaagttatgggaatacctgtggtggttgtgatccctaggtcttgggagctcttggaggtgtctgtatcagtggatttcccatcccctgtgggaaattagtaggctcatttactgttttaggtctagcctatgtggattttttcctaacatacctaagcaaacccagtgtcaggatggtaattcttattctttcgttcagttaagtttttcccttcatctgggcactgaagggatatgtgaaacaatgttaacatttttggtagtcttcaaccagggattgtttctgtttaacttcttataggaaagcttgagtaaaataaatattgtctttttgtatgtcaaaaaaaaaaat

SEQ ID NO: 142 - protein, 198 aa, Homo sapiens
RDIWTMNLQRYWGEIPISSSQTNRSSFDLLPREFRLVEVHDPPLHQPSANKPKPPTMLDIPSEPCSLTIHTIQLIQHNRRLRNLIATAQAQNQQQTEGVKTEESEPLPSCPGSPPLPDDLLPLDCKNPNAPFQIRHSDPESDFYRGKGEPVTELSWHSCRQLLYQGSGTNPGQRRAFDCANESVLEDPNLMLAHEYWP

SEQ ID NO: 143 - protein, 92 aa, Homo sapiens
IVWMVRLHGSEGMSSIVGGFGLLAEGWCRGGSWTSTRRNSRGSKSKELLLVWLDDIGISPQYLCRFIVHMSLQVQQTFIKCQAFCVGQRLIM

SEQ ID NO: 144 - protein, 96 aa, Homo sapiens [sequence omitted]

SEQ ID NO: 145 - protein, 52 aa, Homo sapiens
EGRVQQGSFVNVQQGPQEPFIEFIHQLTQAIKSTHGTSTIPRVSRITLKDKP

SEQ ID NO: 146 - protein, 47 aa, Homo sapiens [sequence omitted]

SEQ ID NO: 147 - protein, 66 aa, Homo sapiens [sequence omitted]

SEQ ID NO: 148 - protein, 187 aa, Homo sapiens
REGEGRPEGNGDIRGGLRSGCDLSLLAPLLPPSSSESWECCYPWKIKLGLQELSVWEESMAQHSACVPFCSGSLSPPPSQPQRLSPSPSSSPEDSSDGRAGPPEPTGSSGCTGSWCSLSPVHFSHWGMECPCILCCRSPHLHLRGLGSPSSPQCPQSLSQTVGWNMRLEAERGSEHHSPCTWVASCP

SEQ ID NO: 149 - protein, 147 aa, Homo sapiens
REDWNRGKGEVAPCFVQPGSWQPWCWGLDPTTPAHLAEHLVPIEDCLPLLLHLQLPPLLGTFHTLQDCVCSGSPEGCSSCCHRASILILLLIVQLLSVCIRLSDQRVHQHQEGHVEQQGTHHGQVDDNDDLDGGGLRSSYLHSHSRQ

SEQ ID NO: 150 - protein, 142 aa, Homo sapiens [sequence omitted]

SEQ ID NO: 151 - protein, 464 aa, Homo sapiens
RQQTVLGSCSSSILPCQLLKHQGSSKTEMTKNWLIQTKRRYFSSPKQMSMTHWPRTAWLTGCSVTLFLFPSQYVDVASLGLVPQLTGGTLYKYNNFQMHLDRQQFLNDLRNDIEKKIGFDAIMRVRTSTGFRATDFFGGILMNNTTDVEMAAIDCDKAVTVEFKHDDKLSEDSGALIQCAVLYTTISGQRRLRIHNLGLNCSSQLADLYKSCETDALINFFAKSAFKAVLHQPLKVIREILVNQTAHMLACYRKNCASPSAASQLILPDSMKVLPVYMNCLLKNCVLLSRPEISTDERAYQRQLVMTMGVADSQLFFYPQLLPIHTLDVKSTMLPAAVRCSESRLSEEGIFLLANGLHMFLWLGVSSPPELIQGIFNVPSFAHINTDMTLLPEVGNPYSQQLRMIMGIIQQKRPYSMKLTIVKQREQPEMVFRQFLVEDKGLYGGSSYVDFLCCVHKEICQLLN

SEQ ID NO: 152 - protein, 172 aa, Homo sapiens
TMLEKIPKEEQEETSAIRVGFITYNKVLHFFNVKSNLAQPQMMGVTDVGEVFVPLLDGFLVNYQESQSVIHNLLDQIPDMFADSNENETVFAPVIQAGMEALKAADCPGKLFIFHSSLPTAEAPGKLKNRDDKKLVNTDKEKILFQPQTNVYDSLAKDCVAHRLLCDTLPLS

SEQ ID NO: 153 - protein, 141 aa, Homo sapiens [sequence omitted]

SEQ ID NO: 154 - protein, 504 aa, Homo sapiens
LDRCGLYPVSSLLQVEGSLWRAAGVFQPPPGLAHANDWRFTARVHGGALGEHDKMVAAATGSEILLWALQAEGGGSEIGVFHLGVPVEALFFVGNQLIATSHTGRIGVWNAVTKHWQVQEVQPITSYDAAGSFLLLGCNNGSIYYVDVQKFPLRMKDNDLLVSELYRDPAEDGVTALSVYLTPKTSDSGNWIEIAYGTSSGGVRVIVQHPETVGSGPQLFQTFTVHRSPVTKIMLSEKHLISVCADNNHVRTWSVTRFRGMISTQPGSTPLASFKILALESADGHGGCSAGNDIGPYGERDDQQVFIQKVVPSASQLFVRLSSTGQRVCSVRSVDGSPTTAFTVLECEGSRRLGSRPRRYLLTGQANGSLAMWDLTTAMDGLGQAPAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 155 - protein, 289 aa, Homo sapiens
GQPARPGAMAAAATAAEGVPSRGPPGEVIHLNVGGKRFSTSRQTLTWIPDSFFSSLLSGRISTLKDETGAIFIDRDPTVFAPILNFLRTKELDPRGVHGSSLLHEAQFYGLTPLVRRLQLREELDRSSCGNVLFNGYLPPPVFPVKRRNRHSLVGPQQLGGRPAPVRRSNTMPPNLGNAGLLGRMLDEKTPPSPSGQPEEPGMVRLVCGHHNWIAVAYTQFLVCYRLKEASGGQLVFSSPRLDWPMRTTGASQPGCMVGLWVNMTRWWQQPPAARSCYGLCRRKAVAPR

SEQ ID NO: 156 - protein, 161 aa, Homo sapiens
VPQDQGIPRHHGSCVVQKEVSLSFILGGVRGVPRPLEGHGAGVGGRRRSGPLRTSSWQRSTKLPPPRRRASACGGLGLPRWPDKEVLLEAEWRLVREMRGEGLGRQPHEGAEGAGGASSQCSSCSISSCSVRPPAGAWPRPSMAVVRSHMAKLPLAWPVSR

SEQ ID NO: 157 - protein, 262 aa, Homo sapiens
QLWGFAAGSDSRPAMGCDGGTIPKRHELVKGPKKVEKVDKDAELVAQWNYCTLSQEILRRPIVACELGRLYNKDAVIEFLLDKSAEKALGKAASHIKSIKNVTELKLSDNPAWEGDKGNTKGDKHDDLQRARFICPVVGLEMNGRHRFCFLRCCGCVFSERALKEIKAEVCHTCGAAFQEDDVIVLNGTKEDVDVLKTRMEERRLRANWKRKQRNPRQQSLFQNQMSVKKPQGHQKLRQGSLKKPALILERRKPTWLPKAQQ

SEQ ID NO: 158 - protein, 138 aa, Homo sapiens
CHRAQWHQGGCGRAEDKDGGEKAESELEKKTKKPKAAESVSKPDVSEEAPGPSKVKTGKPEEASLDSREKKTNLAPKSTAMNESSSGKAGKPPCGATKRSIADSEESEAYKSLFTTHSSAKRSKEESAHWVTHTSYCF

SEQ ID NO: 159 - protein, 168 aa, Homo sapiens [sequence omitted]

SEQ ID NO: 160 - protein, 238 aa, Homo sapiens
HQWHITAMGSQHSAAARPSSCRRKQEDDRDGLLAEREQEEAIAQFPYVEFTGRDSITCLTCQGTGYIPTEQVNELVALIPHSDQRLRPQRTKQYVLLSILLCLLASGLVVFFLFPHSVLVDDDGIKVVKVTFNKQDSLVILTIMATLKIRNSNFYTVAVTSLSSQIQYMNTVVNFTGKAEMGGPFSYVYFFCTVPEILVHNIVIFMRTSVKISYIGLMTQSSLETHHYVDCGGNSTAI

SEQ ID NO: 161 - protein, 91 aa, Homo sapiens
SSHEDHYVVHQDLRYRAEEVHIGKRSSHLGLPGKIHHCVHVLNLAGQAGHCHRVEVGVPDFQGGHDGENYKGVLLIKCDFHHFDAVIIHKD

SEQ ID NO: 162 - protein, 133 aa, Homo sapiens
MRKQEENHQTRCQETKQDGQEDILLSSLRAQSLITVWDQSHQLIYLLCWNVACPLARETGDAISPGEFHIWELSNGFFLLSFSQQTVPVIFLLSPAGGGASSSGMLRPHGRDMPLVSCPASSVGGAARTQRAG

SEQ ID NO: 163 - protein, 91 aa, Homo sapiens
AAGAAGPHRRRHPLHPSLLREHHSQAQAPEGVRPGQSTLSRIEAVQPQLPRPSGLPSLWGWLPWLLGTRPQRHPEIPPETQCASTAVRRSA

SEQ ID NO: 164 - protein, 174 aa, Homo sapiens
LDNPTQRNKDQLIRAAVKFLDTDTICYRVEEPETLVELQRNEWDPIIEWAEKRYGVEISSSTSIMGPSIPAKTREVLVSHLASYNTWALQGIEFVAAQLKSMVLTLGLIDLRLTVEQAVLLSRLEEEYQIQKWGNIEWAHDYELQELRARTAAGTLFIHLCSESTTVKHKLLKE

SEQ ID NO: 165 - protein, 66 aa, Homo sapiens [sequence omitted]

SEQ ID NO: 166 - protein, 132 aa, Homo sapiens
SWRETEIKEQLTEHLCTIIQQNELRKAKKLEELMQQLDVEADEETLELEVEVERLLHEQEVESRRPVVRLERPFQPAEESVTLEFAKENRKCQEQAVSPKVDDQCGNSSSIPFLSPNCPNQEGNDISAALAT

SEQ ID NO: 167 - protein, 67 aa, Homo sapiens
QILMSHSPPQAEMASLNEPLVSLILLLVRVAISRPPPQAPKSLHRLLHLVVASTPPTSWPFGAHFAV

SEQ ID NO: 168 - protein, 74 aa, Homo sapiens [sequence omitted]

SEQ ID NO: 169 - protein, 89 aa, Homo sapiens [sequence omitted]

SEQ ID NO: 170 - protein, 74 aa, Homo sapiens [sequence omitted]

SEQ ID NO: 171 - protein, 89 aa, Homo sapiens [sequence omitted]

SEQ ID NO: 172 - protein, 100 aa, Homo sapiens
PSPAVLGDQPPSASGAVHRKLSLEVCCCQERAQMGPVMAATSTSCGRARLLARSAQWLTTMLSSAAVWLGSRRLLTCGENPSYALVAFLCLSRESPSAKP

SEQ ID NO: 173 - protein, 495 aa, Homo sapiens
SRTNTPVETWKGSKGKQSYTYIIEENTTTSFTWAFQRTTFHEASRKYTNDVAKIYSINVTNVMNGVASYCRPCALEASDVGSSCTSCPAGYYIDRDSGTCHSCPPNTILKAHQPYGVQACVPCGPGTKNNKIHSLCYNDCTFSRNTPTRTFNYNFSALANTVTLAGGPSFTSKGLKYFHHFTLSLCGNQGRKMSVCTDNVTDLRIPEGESGFSKSITAYVCQAVIIPPEVTGYKAGVSSQPVSLADRLIGVTTDMTLDGITSPAELFHLESLGIPDVIFFYRSNDVTQSCSSGRSTTIRVRCSPQKTVPGSLLLPGTCSDGTCDGCNFHFLWESAAACPLCSVADYHAIVSSCVAGIQKTTYVWREPKLCSGGISLPEQRVTICKTIDFWLKVGISAGTCTAILLTVLTCYFWKKNQKLEYKYSKLVMNATLKDCDLPAADSCAIMEGEDVEDDLIFTSKKSLFGKIKSFTSKRTPDGFDSVPLKTSSGGPDMDL

SEQ ID NO: 174 - protein, 118 aa, Homo sapiens
GHNEEISSSGCCRMLAPKSPQACKGAMQGEEAGEAGSASHRSMSGPPEDVFSGTESNPSGVLLEVNDLIFPKSDFLLVKMRSSSTSSPSMMAQLSAAGRSQSLRVAFITSLEYLYSSF

SEQ ID NO: 175 - protein, 172 aa, Homo sapiens
RNTRGHFRACQRKLKPCSVSTVYKFNRNACQRGLFEKRVPSEPVLSVQEKGVLLKRKLSLLEQDVIVNEDGRNKLKKQGETPNEVCMFSLAYGDIPEELIDVSDFECSLCMRLFFEPVTTPCGHSFCKNCLERCLDHAPYCPLCKESLKEYLADRRYCVTQLLEGINSEVSA

SEQ ID NO: 176 - protein, 248 aa, Homo sapiens
QIGGTVSHSCWKELIVKYLPDELSERKKIYDEETAELSHLTKNVPIFVCTMAYPTVPCPLHVFEPRYRLMIRRSIQTGTKQFGMCVSDTQNSFADYGCMLQIRNVHFLPDGRSVVDTVGGKRFRVLKRGMKDGYCTADIEYLEDVKVENEDEIKNLRELHDLVYSQACSWFQNLRDRFRSQILQHFGSMPERRENLQAAPNGPAWCWWLLAVLPVDPRYQLSVLSMKSLKERLTKIQHILTYFSRDQF

SEQ ID NO: 177 - protein, 133 aa, Homo sapiens [sequence omitted]

SEQ ID NO: 178 - protein, 152 aa, Homo sapiens
SAVKRGWDLNMAAVVAATALKGRGARNARVLRGILAGATANKASHNRTRALQSHSSPEGKEEPEPLSPELEYIPRKRGKNPMKAVGLAWAIGFPCGILLFILTKREVDKDRVKQMKARQNMRLSNTGEYESQRFRASSQSAPSPDVGSGVQT

SEQ ID NO: 179 - protein, 114 aa, Homo sapiens
EGRSAPQVCTPDPTSGDGALWEEALNLWLSYSPVLDNRMFCRAFICFTRSLSTSRLVRMKRRIPQGKPMAQASPTAFMGFLPLFLGMYSSSGDRGSGSSLPSGELWLCRARVLL

SEQ ID NO: 180 - protein, 126 aa, Homo sapiens
GLATAWASCALWWTSEARTGIWAKPEDLTVNSLGGSQRSSGLHPRPNIRGRGTLGGSPEPLALILARVGQPHVLPSLHLLHTVLVHFPLGEDEEEDTTREADGPGQSHSFHGVLAPLSGNVFQLRG

SEQ ID NO: 181 - protein, 74 aa, Homo sapiens [sequence omitted]

SEQ ID NO: 182 - protein, 84 aa, Homo sapiens
ILISFKQRQICAFTQAECGHEYSAPAYIQRCTHDSPHQAHTQSHTHTHTHAHTRVHTRTHAHTHAHVNTCTHAHTCTHAHTDTL

SEQ ID NO: 183 - protein, 70 aa, Homo sapiens
VCPCVHVCTCVHVCMCLRVRVCVHVSVCARACVHVCVCACVTVCVLGGGNHAYIFVCMQGLNIHGHILLE

SEQ ID NO: 184 - protein, 71 aa, Homo sapiens [sequence omitted]

SEQ ID NO: 185 - protein, 55 aa, Homo sapiens [sequence omitted]

SEQ ID NO: 186 - protein, 37 aa, Homo sapiens
KQGRLLTSICFSLLRTKANLPCFGSPHFQPSQEFHCS

SEQ ID NO: 187 - protein, 37 aa, Homo sapiens
SPLLWFPALSAFSGISLFIIYFHDLSAKLLIFCRKKV

SEQ ID NO: 188 - protein, 100 aa, Homo sapiens [sequence omitted]

SEQ ID NO: 189 - protein, 256 aa, Homo sapiens
RSQAGPEAGQPLPGSGKRSSCCHCSSGACSMGPLPRTVELFYDVLSPYSWLGFEILCRYQNIWNINLQLRPSLITGIMKDSGNKPPGLLPRKGLYMANDLKLLRHHLQIPIHFPKDFLSVMLEKGSLSAMRFLTAVNLEHPEMLEKASRELWMRVWSRNEDITEPQSILAAAEKAGMSAEQAQGLLEKIATPKVKNQLKETTEAACRYGAFGLPITVAHVDGQTHMLFGSDRMELLAHLLGEKWMGPIPPAVNARL

SEQ ID NO: 190 - protein, 196 aa, Homo sapiens
SLAFTAGGIGPIHFSPSRCASSSIRSEPNNMWVWPSTWATVMGSPKAPYLQAASVVSLSWFFTFGVAIFSRSPWACSADIPAFSAAARMLCGSVMSSFLDQTRIHSSRDAFSSISGCSKFTAVRKRMADKLPFSSITDKKSLGKWMGIWRWCLRSFKSFAMYSPLRGSRPGGLFPLSFMIPVMRLGRNCRLMFQIF

SEQ ID NO: 191 - protein, 116 aa, Homo sapiens
EQRASAMRSSRAFRTVCSSWATHGQLPAGLDDKTNIKTVCTYWEDFHSCTVTALTDCQEGAKDMWDKLRKESKNLNIQGSLFELCGSGNGAAGSLLPAFPVLLVSLSAALATWLSF

SEQ ID NO: 192 - protein, 182 aa, Homo sapiens
KRESGFPTILYECFQHHRESQRPQRTNGSSSRFPGAWSECGWARGGSWPHAQKESQVAKAAERDTRSTGNAGSRDPAAPLPLPQSSNKLPWMLRFLDSFLSLSHISFAPSWQSVRAVTVQLWKSSQYVHTVLMFVLSSRPAGSWPCVAQLEQTVRKALEDRIALARCSHGLHQIRYLHREDQ

SEQ ID NO: 193 - protein, 105 aa, Homo sapiens
HLANKTQEIKRNKKENQDFPQSYMSVFSITENHNVPKELMDLPLDFREHGVSVGGRAGGAGPTLRRKARSLKLPRETPGAPGTPGAGTPPPRCRCRRVRISCLGC

SEQ ID NO: 194 - protein, 426 aa, Homo sapiens
EIYSLSRFIEVKMSKKISGGSVVEMQGDEMTRIIWELIKEKLIFPYVELDLHSYDLGIENRDATNDQVTKDAAEAIKKHNVGVKCATITPDEKRVEEFKLKQMWKSPNGTIRNILGGTVFREAIICKNIPRLVSGWVKPIIIGRHAYGDQYRATDFVVPGPGKVEITYTPSDGTQKVTYLVHNFEEGGGVAMGMYNQDKSIEDFAHSSFQMALSKGWPLYLSTKNTILKKYDGRFKDIFQEIYDKQYKSQFEAQKIWYEHRLIDDMVAQAMKSEGGFIWACKNYDGDVQSDSVAQGYGSLGMMTSVLVCPDGKTVEAEAAHGTVTRHYRMYQKGQETSTNPIASIFAWTRGLAHRAKLDNNKELAFFANALEEVSIETIEAGFMTKDLAACIKGLPNVQRSDYLNTFEFMDKLGENLKIKLAQAKL

SEQ ID NO: 195 - protein, 97 aa, Homo sapiens
RLLPKHLQRRQALYCYQALLCGLTLWSRQKWKQWDWWTSPVLSGTCGSDGLQSRGQPLLLLSCHLDKPARWSSCRESHTLGPQSPTARHHHSFYRPR

SEQ ID NO: 196 - protein, 93 aa, Homo sapiens
LILIIHPHGNTTTFFKVMYQVCHLLGSVTWCVGYLYFSRPRNNKISCSVLIPISMTTYDDRFYPSTHKPGDIFADNGFSEDRATQNISYGAIW

SEQ ID NO: 197 - protein, 410 aa, Homo sapiens
TDQPNIQSVKIHSLPLRNPNKGCECPPRRDGFGFIKCVDRDVRMFFHFSEILDGNQLHIADEVEFTVVPDMLSAQRNHAIRIKKLPKGTVSFHSHSDHRFLGTVEKEATFSNPKTTSPNKGKEKEAEDGIIAYDDCGVKLTIAFQAKDVEGSTSPQIGDKVEFSISDKQRPGQQVATCVRLLGRNSNSKRLLGYVATLKDNFGFIETANHDKEIFFHYSEFSGDVDSLELGDMVEYSLSKGKGNKVSAEKVNKTHSVNGITEEADPTIYSGKVIRPLRSVDPTQTEYQGMIEIVEEGDMKGEVYPFGIVGMANKGDCLQKGESVKFQLCVLGQNAQTMAYNITPLRRATVECVKDQFGFINYEVGDSKKLFFHVKEVQDGIELQAGDEVEFSVIPKSSGGLAGSGACRCF

SEQ ID NO: 198 - protein, 126 aa, Homo sapiens
LNAILNFFHMEKELLAISYFIVNEAKLIFHTFHCGPAQGCDVVSHSLCILAQDTQLELDALPFLQAIPFVGHPNDAKWIDLTFHIALLHNLNHSLVLSLCWINTPQGANYFARVNGGISFLSNAIH

SEQ ID NO: 199 - protein, 85 aa, Homo sapiens
KSHTSCNLLSRPLFVTNTKFNLISYLRRSRSFHILGLKSNSQFHPTVIISNNAILSLLLFAFIWASGFRIGKSGFFFYRAQKTVI

SEQ ID NO: 200 - protein, 79 aa, Homo sapiens
ATMRLSVCLLMVSLALCCYQAHALVCPAVASEITVFLFLSDAAVNLQVAKLNPPPEALAAKLEVKHCTDQISFKKRLLI

SEQ ID NO: 201 - protein, 50 aa, Homo sapiens
SVQCFTSNLAARASGGGLSLATWRFTAASLKNKKTVISEATAGQTRAWAW

SEQ ID NO: 202 - protein, 72 aa, Homo sapiens
QVAVEKTLETQVEHFYMSHTHIFSLFPPRTFSNEKPFLKRYLIGAVLHFQLGCKSFWRWIKFGNLEVYRSVT

SEQ ID NO: 203 - protein, 53 aa, Homo sapiens [sequence omitted]

SEQ ID NO: 204 - protein, 121 aa, Homo sapiens
ALVVRFLTKRFIGDYERNAGNLYTRQVQIEGETLALQVQDTPGIQVHENSLSCSEQLNRCIRWADAVVIVFSITDYKSYELISQLHQHVQQLHLGHPAACGWSWANKSDLLHIKQVDPQLG

SEQ ID NO: 205 - protein, 205 aa, Homo sapiens
GPLPALAAGSTFPVLACSSAMAPKGSSKQQSEEDLLLQDFSRNLSAKSSALFFGNAFIVSAIPIWLYWRIWHMDLIQSAVLYSVMTLVSTYLVAFAYKNVKFVLKHKVAQKREDAVSKEVTRKLSEADNRKMSRKEKDERILWKKNEVADYEATTFSIFYNNTLFLVVVIVASFFILKNFNPTVNYILSISASSGLIALLSTGSK

SEQ ID NO: 206 - protein, 106 aa, Homo sapiens
VLHQDSSPSCLLAPNRPCQLHPLALCLWVACGIWKSSRVVRVGDTRCFYSLEPLKNPAECNSVFVYWLFFDRLLKLNELKGKLRVLGRLLKGKKCLAMCCNHKRRK

SEQ ID NO: 207 - protein, 105 aa, Homo sapiens
STYGQYVVHCGVEVLQYEEGSNNDHDQEQSVVIEDGKCCSFIISNFILLPQDSFIFLLPRHLSIISFRKFSSHFFGNSILPLLCYFVLENKFHILVCKGYQICAY

SEQ ID NO: 208 - protein, 549 aa, Homo sapiens
LYPNFLVNELILKQKQRFEEKRFKLDHSVSSTNGHRWQIFQDWLGTDQDNLDLANVNLMLELLVQKKKQLEAESHAAQLQILMEFLKVARRNKREQLEQIQKELSVLEEDIKRVEEMSGLYSPVSEDSTVPQFEAPSPSHSSIIDSTEYSQPPGFSGSSQTKKQPWYNSTLASRRKRLTAHFEDLEQCYFSTRMSRISDDSRTASQLDEFQECLSKFTRYNSVRPLATLSYASDLYNGSSIVSSIEFDRDCDYFAIAGVTKKIKVYEYDTVIQDAVDIHYPENEMTCNSKISCISWSSYHKNLLASSDYEGTVILWDGFTGQRSKVYQEHEKRCWSVDFNLMDPKLLASGSDDAKVKLWSTNLDNSVASIEAKANVCCVKFSPSSRYHLAFGCADHCVHYYDLRNTKQPIMVFKGHRKAVSYAKFVSGEEIVSASTDSQLKLWNVGKPYCLRSFKGHINEKNFVGLASNGDYIACGSENNSLYLYYKGLSKTLLTFKFDTVKSVLDKDRKEDDTNEFVSAVCWRALPDGESNVLIAANSQGTIKVLELV

SEQ ID NO: 209 - protein, 90 aa, Homo sapiens
GTVLSSLTGEYKPLISSTLLISSSKTLSSFWICSSCSLLFLLATLRNSIRICSWAACDSASSCFFFCTSNSNIRLTLAKSRLSWSVPNQS

SEQ ID NO: 210 - protein, 95 aa, Homo sapiens
FPSSLLFFFFFFFFFCGSINFYCFVIYFYSKEFVSLSQKLDNTTKSSNVHGVTLMVESWLGIPNVPKVIKEGKEKKKKIFKTNPKPMMTLGRDIT

SEQ ID NO: 211 - protein, 80 aa, Homo sapiens
KKMVRLGLFSCLLAIYSLLWIVCIPYLLSIGLCVDILFLFVQHLLPHLLVTQPLFICGEPIPCGLGEHVTRPGLLSPTAS

SEQ ID NO: 212 - protein, 67 aa, Homo sapiens
LKKGKWAKAIHNRKCKWPRNMKRCSSSLIFKEKKEILPTRLAKIFKDSGLADYRQTGILTNDGVVNW

SEQ ID NO: 213 - protein, 78 aa, Homo sapiens
SPEVGQALGTAGSRASRKMTSELSSLSISASIRVSPQTDSLHMAQIQAYMVLGSWDLHKAFFPVVPAEVLLRAFLSLA

SEQ ID NO: 214 - protein, 105 aa, Homo sapiens
QAGKRALYKHTQTNTSGDGCVLLEQRLIKHSVCWLSVPLLENNELGKEQLIRKCALLTVHITTKSWQLLKEKGLCRCRSNLSVNSCQQPQRLPPQHTLITCVCLA

SEQ ID NO: 215 - protein, 216 aa, Homo sapiens
LSLTSRMEEAELVKGRLQAITDKRKIQEEISQKRLKIEEDKLKHQHLKKKALREKWLLDGISSGKEQEEMKKQNQQDQHQIQVLEQSILRLEKEIQDLEKAELQISTKEEAILKKLKSIERTTEDIIRSVKVEREERAEESIEDIYANIPDLPKSYIPSRLRKEINEEKEDDEQNRKALYAMEIKVEKDLRTGESTVLSSIPLPSDDFKRSRSKSL

SEQ ID NO: 216 - protein, 112 aa, Homo sapiens
FCFFISSCSFPLLIPSRSHFSLKAFFFKCWCFSLSSSIFRRFCEISSCIFLLSVMAWSLPFTSSASSILEVKDSQTGKQVQSYHKSRSLLGERSGGDRREAGRNPLFAPVEK

SEQ ID NO: 217 - protein, 339 aa, Homo sapiens
SSQLRRRLVPAPAAPRPRPNHGVLRGRLRGDRWQWSHWAKWAMLFASGGFQVKLYDIEQQQIRNALENIRKEMKLLEQAGSLKGSLSVEEQLSLISGCPNIQEAVEGAMHIQECVPEDLELKKKIFAQLDSIIDDRVILSSSTSCLMPSKLFAGLVHVKQCIVAHPVNPPYYIPLVELVPHPETAPTTVDRTHALMKKIGQCPMRVQKEVAGFVLNRLQYAIISEAWRLVEEGIVSPSDLDLVMSEGLGMRYAFIGPLETMHLNAEGMLSYCDRYSEGIKHVLQTFGPIPEFSRATAEKVNQDMCMKVPDDPEHLAARRQWRDECLMRLAKLKSQVQPQ

SEQ ID NO: 218 - protein, 109 aa, Homo sapiens [sequence omitted]

SEQ ID NO: 219 - protein, 98 aa, Homo sapiens
LNIPSALRCMVSRGPMNAYRMPNPSDMTRSRSLGDTIPSSTSRQASLMIAYCRRFRTKPATSFWTRMGHCPIFFIRAWVLSTVVGAVSGWGTSSTSGM

SEQ ID NO: 220 - protein, 129 aa, Homo sapiens
TMFFTCGPNEAMVVSGFCRSPPVMVAGGRVFVLPCIQQIQRISLNTLTLNVKSEKVYTRHGVPISVTGIAQVKLSEPFPHSPLPHHPLSQTLRHLLATVFSTLACREVPLLVSSFPGTPRHLPPPPFFP

SEQ ID NO: 221 - protein, 118 aa, Homo sapiens
DGDPMASVNLFTLDIEGQCVERDPLDLLDAGQDKDTPSSHHDWGASAEPGDHHGLIWATSEKHGSGWSFRDAGGSPAGVSGRAGSRRDLGAGQGPLADQLSWELAPSRVPHPAAPRCC

SEQ ID NO: 222 - protein, 119 aa, Homo sapiens [sequence omitted]

SEQ ID NO: 223 - protein, 93 aa, Homo sapiens
GRRTLFLATFGGYPGSLGCSLSGEANISLVSFFHPLNCKLRITQAHHYSRLGLASQSTLCPACHCCKELLLCQPKQRKYGFSCIIFPFGWFVF

SEQ ID NO: 224 - protein, 94 aa, Homo sapiens
NLIYPNSSMYSDTFSEKARIIGAVLSIKGKSSDHLHYNFLCLFSAGEEIHIYSTPHWTLQNACIFCPSAICSLPFCLLKELSNIVFPKMFSTGH

SEQ ID NO: 225 - protein, 92 aa, Homo sapiens [sequence omitted]

SEQ ID NO: 226 - protein, 458 aa, Homo sapiens
RGKRRRHRLPALPPRLLSPSAATMSASAVFILDVKGKPLISRNYKGDVAMSKIEHFMPLLVHGEEEGALAPLLSHGQVHFLWIKHSNLYLVATTSKNANASLVYSFLYKTIEVFCEYFKELEEESIRDNFVIVYELLDELMDFGFPQTTDSKILQEYITQQSNKLETGKSRVPPTVTNAVSWRSEGIKYKKNEVFIDVIESVNLLVNANGSVLLSEIVGTIKLKVFLSGMPELRLGLNDRVLFELTGRSKNKSVELEDVKFHQCVRLSRFDNDRTISFIPPDGDFELMSYRLSTQVKPLIWIESVIEKFSHSRVEIMVKAKGQFKKQSVANGVEISVPVPSDADSPRFKTSVGSAKYVPERNVVIWSIKSFPGGKEYLMRAHFGLPSVEKEEVEGRPPIGVKFEIPYFTVSGIQVRYMKIIEKSGYQGPALGFRYIHPEWAITNFRYQLGRGEEMGGF

SEQ ID NO: 227 - protein, 120 aa, Homo sapiens [sequence omitted]

SEQ ID NO: 228 - protein, 246 aa, Homo sapiens
GISNLTPMGGRPSTSSFSTLGRPKWARIKYSLPPGKDLILQITTFLSGTYLALPTLVLNLGESASLGTGTDISTPLATDCFLNCPLALTMISTRLWENFSMTDSIQISGLTWVLRRYDMSSKSPSGGMKEMVRSLSKRESRTHWWNFTSSSSTDLFLLRPVSSKSTRSLRPSRSSGIPDRNTLSLMVPTISLRRTLPLALTSRLTDSMTSMKTSFFLYLIPSERQDTALVTVGGTRDLPVSSLLLC

SEQ ID NO: 229 - protein, 275 aa, Homo sapiens
MNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKWVVWAADRQAALTKLRYSLRQYNIVGLPTNIDFLLNLSGHPEFEAGNVHTDFIPQHHKQLLLSRKAAAKESLCQAALGLILKEKAMTDTFTLQAHDQFSPFSSSSGRRLNISYTRNMTLKDGKNNVAIAVTYNHDGSYSMQIEDKTFQVLGNLYSEGDCTYLKCSVNGVASKAK

SEQ ID NO: 230 - protein, 117 aa, Homo sapiens
SEVIILENTIYLFSKEGSIEIDIPVPKYLSSVSSQETQGGPLAPMTGTIEKVFVKAGDKVKAGDSLMVMIAMKMEHTIKSPKDGTVKKVFYREGAQANRHTPLVEFEEEESDKRESE

SEQ ID NO: 231 - protein, 103 aa, Homo sapiens [sequence omitted]

SEQ ID NO: 232 - protein, 234 aa, Homo sapiens
ADKMFLLPLPAAGRVVVRRLAVRRFGSRSLSTADMTKGLVLGIYSKEKEDDVPQFTSAGENFDKLLAGKLRETLNISGPPLKAGKTRTFYGLHQDFPSVVLVGLGKKAAGIDEQENWHEGKENIRAAVAAGCRQIQDLELSSVEVDPCGDAQAAAEGAVLGLYEYDDLKQKKKMAVSAKLYGSGDQEAWQKGVLFASGQELGHANLMGDASQLRLTPTRFCRNYLRRFSKLVVS

SEQ ID NO: 233 - protein, 108 aa, Homo sapiens [sequence omitted]

SEQ ID NO: 234 - protein, 68 aa, Homo sapiens
CFLCLHASFPVRRFQLPFCRGQLAPRWGSPDADHKRFESSLPSEVVQICSKSLSAFQLTIYQNSLLHL

SEQ ID NO: 235 - protein, 187 aa, Homo sapiens
QRVRAALLSSAMEDSEALGFEHMGLDPRLLQAVTDLGWSRPTLIQEKAIPLALEGKDLLARARTGSGKTAAYAIPMLQLLLHRKATGPVVEQAVRGLVLVPTKELARQAQSMIQQLATYCARDVRVANVSAAEDSVSQRAVLMEKPDVVVGTPSRILSHLQQDSLKLRDSLELLVVDEADLLFSLWL

SEQ ID NO: 236 - protein, 76 aa, Homo sapiens
DIGHSDIPSTVGSQLLNHGLCLPCQLLGRNKNKASHCLFYHRTCRLPMEQQLQHRNSISGRLPGARAGPSQEVLPF

SEQ ID NO: 237 - protein, 112 aa, Homo sapiens [sequence omitted]

SEQ ID NO: 238 - protein, 108 aa, Homo sapiens
CHARLNTDSSRLAMKLLMVLMLAALLLHCYADSGCKLLEDMVEKTINSDISIPEYKELLQEFIDSDAAAEAMGKFKQCFLNQSHRTLKNFGLMMHTVYDSIWCNMKSN

SEQ ID NO: 239 - protein, 82 aa, Homo sapiens
LVEETLLEFPHSLCSGITVYELLKKLFVFRYRYVGIDGLFNHVLQEFAARICIAVQEEGRQHEDHQQLHGEAAAVCVQSCVA

SEQ ID NO: 240 - protein, 48 aa, Homo sapiens
LLFILHQMLSYTVCIISPKFFRVLCDWLRKHCLNFPIASAAASLSMNS

SEQ ID NO: 241 - protein, 56 aa, Homo sapiens
QAVGEKLSSRDSDLMEDRCFPHFSFSPKKVLLLSPFKQPVSLNFCGHGTDKDPVFS

SEQ ID NO: 242 - protein, 52 aa, Homo sapiens
IFVAMGQTRTPSSAELRKSPATSLAIKLQPSHPTRASEEWPLLAGNPLQWAS

SEQ ID NO: 243 - protein, 67 aa, Homo sapiens [sequence omitted]

SEQ ID NO: 244 - protein, 64 aa, Homo sapiens [sequence omitted]

SEQ ID NO: 245 - protein, 74 aa, Homo sapiens [sequence omitted]

SEQ ID NO: 246 - protein, 69 aa, Homo sapiens [sequence omitted]

SEQ ID NO: 247 - protein, 236 aa, Homo sapiens
QLRGGVQRHDRREGEMVCVELVASDKTNTFQGVIFQGSIRYEALKKVYDNRVSVAARMAQKMSFGFYKYSNMEFVRMKGPQGKGHAEMAVSRVSTGDTAPCGTEEDSSPASPMHERVTSFSRPPTPERNNRPAFFSPSLKRKVPRNRIAEMKKSHSANDSEEFFREDDGGADLHNATNLRSRSLSGTGRSLVGSWLKLNRADGNFLLYAHLTYVTLPLHRILTDILEVRQKPILMT

SEQ ID NO: 248 - protein, 161 aa, Homo sapiens [sequence omitted]

SEQ ID NO: 249 - protein, 218 aa, Homo sapiens [sequence omitted]

SEQ ID NO: 250 - protein, 133 aa, Homo sapiens [sequence omitted]

SEQ ID NO: 251 - protein, 71 aa, Homo sapiens [sequence omitted]

SEQ ID NO: 252 - protein, 95 aa, Homo sapiens [sequence omitted]

SEQ ID NO: 253 - protein, 194 aa, Homo sapiens
QKKKMSFRKVNIIILVLAVALFLLVLHHNFLSLSSLLRNEVTDSGIVGPQPIDFVPNALRHAVDGRQEEIPVVIAASEDRLGGAIAAINSIQHNTRSNVIFYIVTLNNTADHLRSWLNSDSLKSIRYKIVNFDPKLLEGKVKEDPDQGESMKPLTFARFYLPILGSQRQRKARLHGVDDVICGRWDFLPFTLQQ

SEQ ID NO: 254 - protein, 109 aa, Homo sapiens
RFHGFPLVRILLYFSFQKFRVKIDNFVSDAFQGITVEPGPEMVCCIVESNNVENHIGASVVLNAVYSCNGPPKPVFRCSDDHRNLLLSPIYCMSESIWDKVYRLRPYNS

SEQ ID NO: 255 - protein, 57 aa, Homo sapiens
NLAKVKGFMDSPWSGSSFTFPSKSLGSKLTILYLMLFRESLLSQDRRWSAVLLRVTM

SEQ ID NO: 256 - protein, 230 aa, Homo sapiens [sequence omitted]

SEQ ID NO: 257 - protein, 141 aa, Homo sapiens [sequence omitted]

SEQ ID NO: 258 - protein, 165 aa, Homo sapiens [sequence omitted]

SEQ ID NO: 259 - protein, 126 aa, Homo sapiens
ERSHLQPGAVGITESPILGLGSAMTTEIGWWKLTFLRKKKSTPKVLYEIPDTYAQTEGDAEPPRPDAGGPNSDFNTRLEKIVDKSTKGKHVKVSNSGRFKEKKKVRATLAENPNLFDDHEEGRSSK

SEQ ID NO: 260 - protein, 121 aa, Homo sapiens
YVLNTIIVGKGEEKIPHPLPRFGPCSFPLRVCDLPSAKVMAKTGTNRPNYHQSSLLQHPNRVPGSSVPSAPEGKVPGSLLPVLGGELKFSVSASGSTETSPYHVASGKCALLRIGPGSSHR

SEQ ID NO: 261 - protein, 86 aa, Homo sapiens
TRVPLYVVRGRVEDPGISQALQKWRHINTNLKNSHFLPAGINWPHSFSYGQRGQRGKVLSQIWLMAGSQEVLAPSSALHFDDRPSS

SEQ ID NO: 262 - protein, 73 aa, Homo sapiens [sequence omitted]

SEQ ID NO: 263 - protein, 106 aa, Homo sapiens [sequence omitted]

SEQ ID NO: 264 - protein, 66 aa, Homo sapiens [sequence omitted]

SEQ ID NO: 265 - protein, 108 aa, Homo sapiens
GCACFRPPSPAGGARTSAGRSPSSADVGSRTQSRSRRRAAHSRCCVAFPSSFTPRSRRRPKRRRRRRENDPAASSLPPAHLPCSVSQSAAGARLVLRPRACGAQAQRP

SEQ ID NO: 266 - protein, 109 aa, Homo sapiens [sequence omitted]

SEQ ID NO: 267 - protein, 157 aa, Homo sapiens [sequence omitted]

SEQ ID NO: 268 - protein, 156 aa, Homo sapiens
SSAQGEEPGPGRRLLRAPTESRSEGKSMFAGVPTMRESSPKQYMQLGGRVLLVLMFMTLLHFDASFFSIVQNIVGTALMILVAIGFKTKLAALTLVVWLFAINVYFNAFWTIPVYKPMHDFLKYDFFQTMSVIGGLLLVVALGPGGVSMDEKKKEW

SEQ ID NO: 269 - protein, 112 aa, Homo sapiens
LGACSWWWPWALGVSPWMRRRRSGNSHRSLPAWLRPVAVKDWFGVDSTKLPAFMYPLPFPSLGKGTDVLRTLFAETPENRWLSLLWSHSLASDPSVQASLAAGSLPHAEALE

SEQ ID NO: 270 - protein, 130 aa, Homo sapiens
SQRVCKYSPGSLLPYPRILVRSSNGFRTWVLFSCDHSSAHCMKTGLSQCFNLTRAVSWSTPRSLLVPYDSPHQMTLAKSRFLCGQGWLADWWKVGWTKGGHVSSQHQFCTSSASVLVGVPVSPGPGWARA

SEQ ID NO: 271 - protein, 267 aa, Homo sapiens
GTSGTSHLHPRSICMIQKYNHDGEAGRLEAFSQGESVLKEPKYQEELEDRLHFYVEECDYLQGFQILCDLHDGFSGVGAKAAELLQDEYSGRGIITWGLLPGPYHRGEAQRNIYRLLNTAFGLVHLTAHSSLVCPLSLGGSLGLRPEPPVSFPYLHYDATLPFHCSAILATALDTVTVPYRLCSSPVSMVHLADMLSFCGKKVVTAGAIIPFPLAPGQSLPDSLMQFGGATPWTPLCACGEPSGTRCFAQSVVLRGYRQSMPHKPQT

SEQ ID NO: 272 - protein, 118 aa, Homo sapiens
QVARVAGPGSHPRTRGRQESCEQSGARDQKLCLIDDRCFSGPPHDGRDQVAGPRLLFPALNIHLVAALPPSRLPQRSHRAGHTGSGSPASSHIPPRRNAACPPALPGTWVPLGHFPLG

SEQ ID NO: 273 - protein, 133 aa, Homo sapiens [sequence omitted]

SEQ ID NO: 274 - protein, 124 aa, Homo sapiens [sequence omitted]

SEQ ID NO: 275 - protein, 426 aa, Homo sapiens
GSSRRHGGGYAAVALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTDVDKSWKELSNVLSGIFCASLNFIDSTNTVTPTASFKPLGLANDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLLHPLPACPGPAATPPPGDADSAAGQ

SEQ ID NO: 276 - protein, 128 aa, Homo sapiens
SPSILYGSCTCHSHKAFGGPDTGGHPSCRPHQVQSCGSGSKTLSLMWINLGRSSVMSSQGSSAPLSTSSTPPTQSLPLPPSNPWVWPMTLTTTFCAMLCCRGRWSAPKTSPPGRSSCPVVPRQASLCC

SEQ ID NO: 277 - protein, 481 aa, Homo sapiens [sequence omitted]

SEQ ID NO: 278 - protein, 128 aa, Homo sapiens [sequence omitted]

SEQ ID NO: 279 - protein, 83 aa, Homo sapiens
ELLNQVKGDHRTEIFHIFQWSTSWAQRPGAVPLAQAADQPEFQLLMFLWYRVVQDGSHSEPDEMEQKTPIFCHLSTSCNSNHP

SEQ ID NO: 280 - protein, 168 aa, Homo sapiens
FYDRRDCFVAVSFLRGLSLWLHFYLWWLCYGGAEMRQKRKGDLSPAELMMLTIGDVIKQLIEAHEQGKDIDLNKVKTKTAAKYGLSAQPRLVDIIAAVPPQYRKVLMPKLKAKPIRTASGIAVVAVMCKPHRCPHISFTGNICVYCPGGPDSDFEYSTQSYTGYEQPP

SEQ ID NO: 281 - protein, 70 aa, Homo sapiens
GGTAAMISTRRGWAERPYLAAVLVFTLFRSMSFPCSWASISCLITSPIVSIISSAGLRSPFRFCLISAPP

SEQ ID NO: 282 - protein, 71 aa, Homo sapiens [sequence omitted]

SEQ ID NO: 283 - protein, 114 aa, Homo sapiens [sequence omitted]

SEQ ID NO: 284 - protein, 127 aa, Homo sapiens
WVSPLTWASRPCDTEEGRQAMISTRRGWAERPYLAAVLVFTLFRSMSFPCSWASISCLITSPIVSIISSAGLRSPDYGGFTTRPGSNILGSRVGHYTHQTMEDSPPDQEATAWAPELATPPCTDEDR

SEQ ID NO: 285 - protein, 92 aa, Homo sapiens
PHTTNPTCFKLFLIRCPCPVRKRVHIWHGIAPHGGWLIAQCKTGWNTQNQNQVPPRAVYTYISCKTDVWTSVGFAHHSHDSNPTSSSDGFRL

SEQ ID NO: 286 - protein, 76 aa, Homo sapiens
DLSRPGGTRFVLTIQQTFFSKVFVQDNFKNNIKINNGFDFSLKIEKKGVGGGVNHWPFFFWRGPIGIVRPWGSGLS

SEQ ID NO: 287 - protein, 97 aa, Homo sapiens
RTFVLFYHRLTLQLLINTSFGDVWCKTHKHTQKSTSPLHDPSLLSGTISAASCTLLGPPPIHRGFRGTQITAGFQFFFNNTFLWSVPTALSVLLKLE

SEQ ID NO: 288 - protein, 77 aa, Homo sapiens
ILHLEMYGVKHTNTHKKAQARCMTRLSFLGLFLLRPAPSWAHLRFTEVSGGPKSLLVFNFFLTIHFCGQFQQHCPYF

SEQ ID NO: 289 - protein, 28 aa, Homo sapiens
ILIDGVRAAFIPYREYNGARLSRDFISA

SEQ ID NO: 290 - protein, 28 aa, Homo sapiens
HQFHNYFNLLGFIHLIILKFHQQWGTEK

SEQ ID NO: 291 - protein, 29 aa, Homo sapiens
APGPQAILIINLNRWGKSCLHPIQRIQWC

SEQ ID NO: 292 - protein, 30 aa, Homo sapiens
AEIKSLLSLAPLYSLYGMKAALTPSIKIYY

SEQ ID NO: 293 - protein, 33 aa, Homo sapiens
AMKVLSFLLCIRISFLFVVESIVRGISKLNEVN

SEQ ID NO: 294 - protein, 38 aa, Homo sapiens [sequence omitted]

SEQ ID NO: 295 - protein, 40 aa, Homo sapiens
FTSFNLLIPRTILSTTNRNEILIHKRKLKTFIAYVGLSNK

SEQ ID NO: 296 - protein, 71 aa, Homo sapiens
VNLLKYGQIHLAVKQLNIHCYLIKVFVSVLPGPNIKTTSVQKINVQRAVCSLFWYVHFKKTPLSSLANQEY

SEQ ID NO: 297 - protein, 67 aa, Homo sapiens [sequence omitted]

SEQ ID NO: 298 - protein, 56 aa, Homo sapiens
KNLEFFSPSTSYLLLQNSSEGFIYILSYPEGPTAGIPLPGLLAERHRAVKAKIKLQ

SEQ ID NO: 299 - protein, 140 aa, Homo sapiens
TPNSRGAGRVVRGSARGVGRSCASWLPVGRRCRTSETGSGASRRSRAIGSPPPSPCPWSANSASSARPTSSSGPKPSFIAFRFGGQSLPPFISLWVQELDFFIWSIYISYISILRDLKQELLMGGQQTIYSCSSLTGFAS

SEQ ID NO: 300 - protein, 279 aa, Homo sapiens
QSRSRPRREGVGTGSRAVLCILATCGSKMSDIGDWFRSIPAITRYWFAATVAVPLVGKLGLISPAYLFLWPEAFLYRFQIWRPITATFYFPVGPGTGFLYLVNLYFLYQYSTRLETGAFDGRPADYLFMLLFNWICIVITGLAMDMQLLMIPLIMSVLYVWAQLNRDMIVSFWFGTRFKACYLPWVILGFNYIIGGSVINELIGNLVGHLYFFLMFRYPMDLGGRNFLSTPQFLYRWLPSRRGGVSGFGVPPASMRRAADQNGGGGRHNWGQGFRLGDQ

SEQ ID NO: 301 - protein, 106 aa, Homo sapiens
IDQIKKSSSWTHREIKGGSDWPPNLKAIKEGFGPEEEVGRADEAEFADQGHGDGGGEPIARDRRDAPEPVSDVRHLRPTGSQDAQDRPTPRADPLTTRPAPRLLGV

SEQ ID NO: 302 - protein, 207 aa, Homo sapiens
LEPLEPNRLELKKGYLTLSDSGDKVAVEWDKDHGVLESHLAEKGRGMELSDLIVFNGKLYSVDDRTGVVYQIEGSKAVPWVILSDGDGTVEKGFKAEWLAVKDERLYVGGLGKEWTTTTGDVVNENPEWVKVVGYKGSVDHENWVSNYNALRAAAGIQPPGNLIHESACWSDTLQRWFFLPRRASQERYSEEGRRAQGRQPAAERLP

SEQ ID NO: 303 - protein, 153 aa, Homo sapiens
RWWATRAAWTTRTGCPTTTPCGLLPASSRQVTSSMSLPAGVTRCSAGSSCRAAPARSATARKDDERKGANLLLSASPDFGDIAVSHVGAVVPTHGFSSFKFIPNTDDQIIVALKSEEDSGRVASYIMAFTLDGRFLLPETKIGSVKYEGIEFI

SEQ ID NO: 304 - protein, 174 aa, Homo sapiens
VGTTAPTWLTAMSPKSGEALSSRLAPLRSSSFLAVALLAGAARQEEPALQRVTPAGRLMDEVTWRLDAGSSPQGVVVGHPVLVVHAALVAHHLHPLRVLVHHITRSGRPLLAQAAHVQTLVLHCQPFGLEAFLHGAVAVGQNHPGHGFAAFDLVDDPRPVIHGVEFPIENNQVG

SEQ ID NO: 305 - protein, 61 aa, Homo sapiens
KLVCLEADSKSSFSSEHLFSYHLISILKHHGCSCSKMGDVKENYLETFISSPKWSFILCLS

SEQ ID NO: 306 - protein, 144 aa, Homo sapiens
NTMAVAAVKWVMSKRTILKHLFPVQNGALYCVCHKSTYSPLPDDYNCNVELALTSDGRTIVCYHPSVDIPYEHTKPIPRPDPVHNNEETHDQVLKTRLEEKVEHLEEGPMIEQLSKMFFTTKHRWYPHGRYHRCRKNLNPPKDR

SEQ ID NO: 307 - protein, 128 aa, Homo sapiens
IHQTAFSQMANEAHFSLIPPGTSASSVFWRIQILTTSVIPSMRIPTVLSSKEHFAKLFYHRSFLKVFNFFFQSGFQHLIMCFFIIMHRIWPRDRFCVFIWNVHRRVVAYYCPAIRSQSKLYVAIIVIW

SEQ ID NO: 308 - protein, 467 aa, Homo sapiens
SRSKMAALRALCGFRGVAAQVLRPGAGVRLPIQPSRGVRQWQPDVEWAQQFGGAVMYPSKETAHWKPPPWNDVDPPKDTIVKNITLNFGPQHPAAHGVLRLVMELSGEMVRKCDPHIGLLHRGTEKLIEYKTYLQALPYFDRLDYVSMMCNEQAYSLAVEKLLNIRPPPRAQWIRVLFGEITRLLNHIMAVTTHALDLGAMTPFFWLFEEREKMFEFYERVSGARMHAAYIRPGGVHQDLPLGLMDDIYQFSKNFSLRLDELEELLTNNRIWRNRTIDIGVVTAEEALNYGFSGVMLRGSGIQWDLRKTQPYDVYDQVEFDVPVGSRGDCYDRYLCRVEEMRQSLRIIAQCLNKMPPGEIKVDDAKVSPPKRAEMKTSMESLIHHFKLYTEGYQVPPGATYTAIEAPKGEFGVYLVSDGSSRPYRCKIKAPGFAHLAGLDKMSKGHMLADVVAIIGTQDIVFGEVDR

SEQ ID NO: 309 - protein, 131 aa, Homo sapiens
QPSVHEHTHTHTHTHTHTQRPISSEEQAPQKKLIGRGDQTLLPCSPIYFSKYNILGTYDGNDICQHVSLRHLVQTSQMGKTRSLDLASIRAAAAIRHQVHPKLSLGSLNGSICGSWRNLVALSIQLKVMNQ

SEQ ID NO: 310 - protein, 100 aa, Homo sapiens
SQDTMRCWVLGPKVQGNVLHNCVLWRVHIIPRWRLPVGCFFAWVHNSSPKLLCPFHIWLPLPNTSAGLNRQSDSSPRPQHLGRDAPEAAQSPQRRHLTPA

SEQ ID NO: 311 - protein, 162 aa, Homo sapiens
RRLRGGEPSTDRRRDPESRTPAPPPTPRAMDPKDRKKIQFSVPAPPSQLDPRQVEMIRRRRPTPAMLFRLSEHSSPEEEASPHQRASGEGHHLKSKRPNPCAYTPPSLKAVQRIAESHLQSISNLNENQASEEEDELGELRELGYPREEDEEEEEDAARLKS

SEQ ID NO: 312 - protein, 154 aa, Homo sapiens
VSLGRNLSALPPLSLAHRHPACISQEEVEGTSLFPRNPLYPHPVLCSSPRLLGLRLLTSRRLRLVCVCLFAHLWLIPREPGHLLPDAHPCQSFLHSPSGRWDVRQPTLENPENREQGFALHNSTPQILSPGHRRPTGQDPKIWGKEVLRTLRYP

SEQ ID NO: 313 - protein, 101 aa, Homo sapiens [sequence omitted]

SEQ ID NO: 314 - protein, 162 aa, Homo sapiens
SDRWTCSPPLGARSMSRFPAVAGRAPRRQEEGERSRDLQEERLSAVCIADREEKGCTSQEGGTTPTFPIQKQRKKIIQAVRDNSFLIVTGNTGSGKTTQLPKYLYEAGFSQHGMIGVTQPRKVAAISVAQRVAEEMKCTLGSKVGYQVRFDDCSSKETAIKY

SEQ ID NO: 315 - protein, 79 aa, Homo sapiens
QIGGRARLHSGPGLCPGFPQSRAGRQGGRRRVSGQETSRKSGSRLFASPIEKRKDARPRREELLQLFLFRNKEKRLFKL

SEQ ID NO: 316 - protein, 69 aa, Homo sapiens
IGKVGVVPPSWDVHPFSSLSAMQTAESRSSWRSLDRSPSSCRLGALPATAGNRDIDLAPSGGEHVHRSE

SEQ ID NO: 317 - protein, 173 aa, Homo sapiens
AQESPWQLCRGARTSKRKLPKLGMEQHCNEMCPPSSLFLPGAYKAQMYSDVWTNTKKKKKKKKKKAFLSHRHKTQIIYCYEALFTNGQFLHFIAACERLPDGRPISLVLQTSSQAAFYQKGENSCLSFLKNAFLYLSIRHYTSELYKRPGGTMSLVDTFHCSVAPFLAWEASA

SEQ ID NO: 318 - protein, 96 aa, Homo sapiens
AQESPWQLCRGARTSKRKLPKLGMEQHCNEMCPPSSLFLPGAYKAQMYSDVWTNTKKHFLKRKGMSFPLFDKKQPVMKSGAQERWVSHLEAFRTQL

SEQ ID NO: 319 - protein, 105 aa, Homo sapiens
TCEPFRNPQVGKDPTPSLRIICLAITGSWKCFLGCVKINQGGMKHIFLATKLEFLREQMQRDLLLLARLQGPLWSHTEAVTGHKPRRARGSCAEAPGPLSGSFPS

SEQ ID NO: 320 - protein, 82 aa, Homo sapiens
IRKREQGRSSPAPWESVFASVPFRGDDGIFDDNFIEERKQGLEQFINKVAGHPLAQNERCLHMFLQDEIIDKSYTPSKIRHA

SEQ ID NO: 321 - protein, 159 aa, Homo sapiens
RASPCPHGGQQRRRRRLNAEGAEGARGGGSSYSEMAETVADTRRLITKPQNLNDAYGPPSNFLEIDVSNPQTVGVGRGRFTTYEIRVKTNLPIFKLKESTVRRRYSDFEWLRSELERESKVVVPPLPGKAFLRQFLLEEMMEYLMTILLRKENKGWSSL

SEQ ID NO: 322 - protein, 114 aa, Homo sapiens
FTSQPFKVTVSSSNSRFFQLENRKICLDPDFVSGEAAPADPHRLRVAHIDLEEVAGGSVGVIQVLRLGDQPPGVSHGLRHFAVAAAAAAGSLRPLRVQPPPPPLLPAVGTRARA

SEQ ID NO: 323 - protein, 374 aa, Homo sapiens
RRAQESPLGRQSHLPRIYQAFLMSATFNEDVQALKELILHNPVTLKLQESQLPGPDQLQQFQVVCETEEDKFLLLYALLKLSLIRGKSLLFVNTLERSYRLRLFLEQFSIPTCVLNGELPLRSRCHIISQFNQGFYDCVIATDAEVLGAPVKGKRRGRGPKGDKASDPEAGVARGIDFHHVSAVLNFDLPPTPEAYIHRAGRTARANNPGIVLTFVLPTEQFHLGKIEELLSGENRGPILLPYQFRMEEIEGFRYRCRDAMRSVTKQAIREARLKEIKEELLHSEKLKTYFEDNPRDLQLLRHDLPLHPAVVKPHLGHVPDYLVPPALRGLVRPHKKRKKLSSSCRKAKRAKSQNPLRSFKHKGKKFRPTAKPS

SEQ ID NO: 324 - protein, 224 aa, Homo sapiens [sequence omitted]

SEQ ID NO: 325 - protein, 115 aa, Homo sapiens [sequence omitted]

SEQ ID NO: 326 - protein, 66 aa, Homo sapiens
YLQCQRSLCGAKCVTWAVETRHLLSPALMTLRKEDVIQGKFLIPKLPVHVNRTSFYSSRCTGSLAP

SEQ ID NO: 327 - protein, 90 aa, Homo sapiens
FRSCLFMLTGLLFIRQDVLVPWHLKGNPDKGKPVEPFGPIGSQDPSPVFHRYYHVFREGELEGACRTVSDVRILQSYYDQGNWCVILQKA

SEQ ID NO: 328 - protein, 83 aa, Homo sapiens [sequence omitted]

SEQ ID NO: 329 - protein, 185 aa, Homo sapiens
ERRSKSREEREKEREREREERERKRRREEEEREKERARDRERRKRSRSRSRHSSRTSDRRCSRSRDHKRSRSRERRRSRSRDRRRSRSHDRSERKHRSRSRDRRRSKSRDRKSYKHRSKSRDREQDRKSKEKEKRGSDDKKSSVKSGSREKQSEDTNTESKESDTKNEVNGTSEDIKSEGDTQSN

SEQ ID NO: 330 - protein, 178 aa, Homo sapiens [sequence omitted]

SEQ ID NO: 331 - protein, 182 aa, Homo sapiens [sequence omitted]

SEQ ID NO: 332 - protein, 88 aa, Homo sapiens
GFGMQLVILRVTIFLPWCFAVPVPPAADHKGWDFVEGYFHQFFLTEKESPLLTQETQTQLLQQFHRNGTDLLDMQMHASATAAPLWGA

SEQ ID NO: 333 - protein, 61 aa, Homo sapiens [sequence omitted]

SEQ ID NO: 334 - protein, 62 aa, Homo sapiens [sequence omitted]

SEQ ID NO: 335 - protein, 61 aa, Homo sapiens
VCPIPMELLQELCLCLLGKEWRLLLGQEKLMEIALNKVPSFMVCSRGHWNGETPGQEDSNS

SEQ ID NO: 336 - protein, 63 aa, Homo sapiens
AEDTIQKRNSQFETVTPPAPNCGDEERKQWLWFLSEGRLRTERSNHQGHRFWKSSRGGWLEEQ

SEQ ID NO: 337 - protein, 65 aa, Homo sapiens
KGWRSDFTVGGRQRDGQHVQTGSFFSISLLSKSRTAQWLCQGGSSSYSHFSGSLKSTRYYRGSRS

SEQ ID NO: 338 - protein, 249 aa, Homo sapiens
SCGDVEQKIQFKRETASLKLLPHQPRIVEMKKGSNGYGFYLRAGSEQKGQIIKDIDSGSPAEEAGLKNNDLVVAVNGESVETLDHDSVVEMIRKGGDQTSLLVVDKETDNMYRLAHFSPFLYYQSQELPNGSVKEAPAPTPTSLEVSSPPDTTEEVDHKPKLCRLAKGENGYGFHLNAIRGLPGSFIKEVQKGGPADLAGLEDEDVIIEVNGVNVLDEPYEKVVDRIQSSGKNVTLLVCGKKAYDYFQA

SEQ ID NO: 339 - protein, 67 aa, Homo sapiens
ITGVQPEHIQYLKNYFHLWTRQLAHIYHYYIHGPKGNEIRTSKEVEPFNNIDIEISMFEKGKVPKIV

SEQ ID NO: 340 - protein, 44 aa, Homo sapiens
RIFITTIFMAQKEMKYEHQKKLNLSTILILKFLCLKKGRYLRLS

SEQ ID NO: 341 - protein, 46 aa, Homo sapiens
KVQLLLMFVFHFLLGHEYSSDKYALTVVSKGGNNFSSTVCVLVVPL

SEQ ID NO: 342 - protein, 237 aa, Homo sapiens
GRWRRRLRHGRGSAEAVGPTAMAELLQEELSVLAAIFCRPHEWEVLSRSETDGTVFRIHTKAEGFMDADIPLELVFHLPVNYPSCLPGISINSEQLTRAQCVTVKEKLLEQAESLLSEPMVHELVLWIQQNLRHILSQPETGSGSEKCTFSTSTTMDDGLWITLLHLDHMRAKTKYVKIVEKWASDLRLTGRLMFMGKIILDFTTGRQKQPQGVLDSSENLQSRCGLKWKEMQREND

SEQ ID NO: 343 - protein, 89 aa, Homo sapiens
YLILLQGDRNNLKVYLILQKTSKVDVDSSGKKCKEKMISVLFETKVQTEHKRFLAFEVKEYSALDELQKEFETAGLKKLFSEFVLALVK

SEQ ID NO: 344 - protein, 95 aa, Homo sapiens
PLPKSNAKTTKNTAILLKDSCLPFHFTRASTNSEKSFLSPAVSNSFCNSSNAEYSLTSNARNLLCSVCTFVSNSTLIIFSLHFFPLESTSTLEVF

SEQ ID NO: 345 - protein, 72 aa, Homo sapiens
RAGLFPGRRVGLEAENGPCCHQHGDFVPCPVLSARMSQPEAEEAALVAHAVGHDCVCSGGGVLLPHHRRNNL

SEQ ID NO: 346 - protein, 171 aa, Homo sapiens
GRACFRGGAWGLRPRTALAATNMETLYRVPFLVLECPNLKLKKPPWLHMPSAMTVYALVVVSYFLITGGIIYDVIVEPPSVGSMTDEHGHQRPVAFLAYRVNGQYIMEGLASSFLFTMGGLGFIILDRSNAPNIPKLNRFLLLFIGFVCVLLSFFMARVFMRMKLPGYLMG

SEQ ID NO: 347 - protein, 82 aa, Homo sapiens
EAGCKSFHNILSIYSVGQESYWPLMPMFISHRTDTWRFNNNIINYSSGDEEVRHHHQSIHSHGRRHVQPGRLLQLQVGTFEH

SEQ ID NO: 348 - protein, 103 aa, Homo sapiens
HKVIVVWNNIGEKAPDELWNSLGPHPIPVIFKQQTANRMRNRLQVFPELETNAVLMVDDDTLISTPDLVFAFSVWQQFPDQIVGICFLESTSFTFIQGIYSYW

SEQ ID NO: 349 - protein, 50 aa, Homo sapiens
ESKNKVWGADECVIIYHQHCIGFQFRKDLESISHPVCCLLFEDHRDRVGP

SEQ ID NO: 350 - protein, 79 aa, Homo sapiens
SGNCCQTEKAKTRSGVLMSVSSSTINTALVSSSGKTWSRFLILFAVCCLKITGIGWGPREFHNSSGAFSPILFHTTITL

SEQ ID NO: 351 - protein, 70 aa, Homo sapiens [sequence omitted]

SEQ ID NO: 352 - protein, 71 aa, Homo sapiens
HLIPFMAKSSFRVGNTQTFCACCSPKAWSSQSPEFWCVLPPPGYTERRQESGVPEAYTCGYPSNKRHPVLR

SEQ ID NO: 353 - protein, 60 aa, Homo sapiens [sequence omitted]

SEQ ID NO: 354 - protein, 225 aa, Homo sapiens
GLPARRPQCFLRAEMANSGLQLLGFSMALLGWVGLVACTAIPQWQMSSYAGDNIITAQAMYKGLWMDCVTQSTGMMSCKMYDSVLALSAALQATRALMVVSLVLGFLAMFVATMGMKCTRCGGDDKVKKARIAMGGGIIFIVAGLAALVACSWYGHQIVTDFYNPLIPTNIKYEFGPAIFIGWAGSALVILGGALLSCSCPGNESKAGYRAPRSYPKSNSSKEYV

SEQ ID NO: 355 - protein, 111 aa, Homo sapiens
QHHHGPGHVQGAVDGLRHAEHGDDELQNVRLGARPVRGLAGHSSPNGGLPGAGLPGHVCGHDGHEVHALWGRRQSEEGPYSHGWRHNFHRGRSCRLGSLLLVWPSDCHRLL

SEQ ID NO: 356 - protein, 154 aa, Homo sapiens [sequence omitted]

SEQ ID NO: 357 - protein, 72 aa, Homo sapiens [sequence omitted]

SEQ ID NO: 358 - protein, 69 aa, Homo sapiens [sequence omitted]

SEQ ID NO: 359 - skipped

SEQ ID NO: 360 - protein, 53 aa, Homo sapiens
KRYNQRETTRKTGVKVLPTSLMRSSCLVTSSAKSSLTSNTSTGMFIRASKWSL

SEQ ID NO: 361 - protein, 111 aa, Homo sapiens
SCWETKWTSCPRMLLATGRGCGSDCGRTVPAPGSCWPLAPRATAPRQGRATGRGESESAELVPHSGQGRAADQRQDRLWSGRVDLCPSALLALPWGRLLSGRHQRRQIHSL

SEQ ID NO: 362 - protein, 109 aa, Homo sapiens [sequence omitted]

SEQ ID NO: 363 - protein, 381 aa, Homo sapiens
GPARRPAARLARAGGPQAADRAGKQSGPPAPGCSWLPAEAAGATVGGLCPRRAPAGPWHQGPQRPVKDEPQDGENPNPPNWSRTVVRDVRLISAKTGYGVEELISALQRSWRYRGDVYLVGATNAGKSTLFNTLLESDYCTAKGSEAIDRATISPWPGTTLNLLKFPICNPTPYRMFKRHQRLKKDSTQAEEDLSEQEQNQLNVLKKHGYVVGRVGRTFLYSEEQKDNIPFEFDADSLAFDMENDPVMGTHKSTKQVELTAQDVKDAHWFYDTPGITKENCILNLLTEKEVNIVLPTQSIVPRTFVLKPGMVLFLGAIGRIDFLQGNQSAWFTVVASNILPVHITSLDRADALYQKHAGHTLLQIPMGGKERMGRISSSCC

SEQ ID NO: 364 - protein, 182 aa, Homo sapiens
QPSTTCTSVLVCLLSAMPLPVALQTRLAKRGILKHLEPEPEEEIIAEDYDDDPVDYEATRLEGLPPSWYKVFDPSCGLPYYWNADTDLVSWLSPHDPNSVVTKSAKKLRSSNADAEEKLDRSHDKSDRGHDKSDRSHEKLDRGHDKSDRGHDKSDRDRERGYDKSRNGIRDRGYDQADREEG

SEQ ID NO: 365 - protein, 149 aa, Homo sapiens
RRHERDGRCDSLPLPARVYWSVCYQLCRCPLRCRPAWPREASSNIWSLNQRKRSLPRTMTMILWTTRPPGWRAYHQAGTRCSTLPAGSLTTGMQTQTLYPGSPHMTPTPWLPNRPRSSEAVMQMLKKSWTGAMTSRTGAMTSRTAAMRN

SEQ ID NO: 366 - protein, 80 aa, Homo sapiens
PRSRSLSDLSWPRSDLSWPLSSFSWLRSDLSWPLSDLSWLRSNFSSASALLLLSFLADLVTTELGSCGESQDTRSVSAFQ

SEQ ID NO: 367 - protein, 160 aa, Homo sapiens
VAQQPALIHGYRKAVLTPNHVEFSRLYDAVLRGPMDSDDSHGSVLRLSQALGNVTVVQKGERDILSNGQQVLVCSQEGSSRRCGGQGDLLSGSLGVLVHWALLAGPQKTNGSSPLLVAAFGACSLTRQCNHQAFQKHGRSTTTSDMIAEVGAAFSKLFET

SEQ ID NO: 368 - protein, 164 aa, Homo sapiens
ILNGNQFMLKLKIWQAPYAFSTRVGPDFPITHTLSPVQGACLLLVCAGSGFKELAEGGPHLGDHVGGGGGATVLLEGLVVALPGERAGAKRGHQERAGPICFLWSSKERPVYQDAQGARQEVPLPSTPAAAAFLAAHKHLLAVGEDVALSFLDHRHVAQGLAES

SEQ ID NO: 369 - protein, 187 aa, Homo sapiens
KSGKHRTPSAHAWVRIFPSHTRSPPSKVPVYFWSARAQVSKSLLKAAPTSAIMSEVVVERPCFWKAWWLHCLVREQAPNAATRRGLDPFVFCGPARSAQCTRTPREPDRRSPCPPHLRLLPSWLHTSTCWPLERMSRSPFWTTVTLPRAWLSLSTDPWLSSLSIGPLSTASYSLLNSTWLGVSTAFR

SEQ ID NO: 370 - protein, 40 aa, Homo sapiens
LFLFTNHNDSGKPGCKHQHCHQLRICDQECHLTVTGRRQK

SEQ ID NO: 371 - protein, 34 aa, Homo sapiens
QAEDKSETGLMRITGKLALAPPENELFHSLADHP

SEQ ID NO: 372 - protein, 38 aa, Homo sapiens
NSSFSGGAKASFPVIRISPVSLLSSACYREMALLITDP

SEQ ID NO: 373 - protein, 123 aa, Homo sapiens
RQLFGIVSIATLTVLAYERYIRVVHARVINFSWAWRAITYIWLYSLAWAGAPLLGWNRYILDVHGLGCTVDWKSKDANDSSFVLFLFLGCLVVPLGVIAHCYGHILYFHSNASLVWKIFRQFK

SEQ ID NO: 374 - protein, 121 aa, Homo sapiens [sequence omitted]

SEQ ID NO: 375 - protein, 58 aa, Homo sapiens
HPGAPPGSQEIRKAQRRNRWHPWISSPQCSLVRVRPGCTCSIPGEVLLPTPVSRARCR

SEQ ID NO: 376 - protein, 49 aa, Homo sapiens [sequence omitted]

SEQ ID NO: 377 - protein, 68 aa, Homo sapiens [sequence omitted]

SEQ ID NO: 378 - protein, 64 aa, Homo sapiens [sequence omitted]

SEQ ID NO: 379 - protein, 144 aa, Homo sapiens
APISSNFCSESIWGYCDQLKVSESTHVLQPFLPSILDGLIHLAAQFSSEVLNLVMETLCIVCTVDPEFTASMESKICPFTIAIFLKYSNDPVVASLAQDIFKELSQIEACQGPMQMRLIPTLVSIMQAPADKIPAGLCATPLIS

SEQ ID NO: 380 - protein, 254 aa, Homo sapiens
YEIQSLPFPSFSSAKLSLLWHSVPFTQMTMPSVQNGGECLRAYVSVTLEQVAQWHDEQGHNGLWYVMQVVSQLLDPRTSEFTAAFVGRLVSTLISKAGRELGENLDQILRAILSKMQQAETLSVMQSLIMVFAHLVHTQLEPLLEFLCSLPGPTGKPALEFVMAEWTSRQHLFYGQYEGKVSSVALCKLLQHGINADDKRLQDIRVKGEEIYSMDEGIRTRSKSAKNPERWTNIPLLVKILKLIINELSNVMGG

SEQ ID NO: 381 - protein, 95 aa, Homo sapiens [sequence omitted]

SEQ ID NO: 382 - protein, 263 aa, Homo sapiens
APISSNFCSESIWGYCDQLKVSESTHVLQPFLPSILDGLIHLAAQFSSEVLNLVMETLCIVCTVDPEFTASMESKICPFTIAIFLKYSNDPVVASLAQDIFKELSQIEACQGPMQMRLIPTLVSIMQAPADKIPAGLCATPIDILTTVVRNTKPPLSQLLICQAFPAVAQCTLHTDDNATMQNGGECLRAYVSVTLEQVAQWHDEQGHNGLWYVMQVVSQLLDPRTSEFTAAFVGRLCFHPHLQGRAGTRGESRPDFFVPSFS

SEQ ID NO: 383 - protein, 68 aa, Homo sapiens
TLRCGGPGAGSPLASHTTVHCGPAHHATGLLVPGSLTHRPASTLRHSAWWHCHLCEGYTVPQQGKLGR

SEQ ID NO: 384 - protein, 97 aa, Homo sapiens
HIGPQALSAILHGGIVICVKGTLCHSRESLADEKLGKGRLCISYYCCQDINGCRTKPCRNLVCWGLHYADQSGNQPHLHWALTGFNLGQLLEDVLSQ

SEQ ID NO: 385 - protein, 140 aa, Homo sapiens [sequence omitted]

SEQ ID NO: 386 - protein, 49 aa, Homo sapiens [sequence omitted]

SEQ ID NO: 387 - protein, 51 aa, Homo sapiens [sequence omitted]

SEQ ID NO: 388 - protein, 97 aa, Homo sapiens [sequence omitted]

SEQ ID NO: 389 - protein, 148 aa, Homo sapiens [sequence omitted]

SEQ ID NO: 390 - protein, 84 aa, Homo sapiens
GPRDRLIQPSYFQRGKWGLEVTEHLAGALAPLASHRLPSSWDYRHTVTEAGPVCNSRCHLQLKHSSYVMSLVTKVKLSHPEKAT

SEQ ID NO: 391 - protein, 59 aa, Homo sapiens
CGKKCITLFLFLSPSLPLWCLRYWGSHSWGHSEATRNASSLHLAVSARTRNPQTSSQTS

SEQ ID NO: 392 - protein, 107 aa, Homo sapiens [sequence omitted]

SEQ ID NO: 393 - protein, 61 aa, Homo sapiens
VAPAVGSPVSQAPQRQRGGQEQKQSYAFLSTLKKRNYTFRGMLSPRSTSSPVFHDLPTKKI

SEQ ID NO: 394 - protein, 74 aa, Homo sapiens
CNCAPSLPDFSPLHPQCGISLVPRGTPLDLWTSRPGQEAATRNPRPLLLKFTASVVVPDSSPAPGTTSTWGGAF

SEQ ID NO: 395 - protein, 112 aa, Homo sapiens
ATVHPACQIFPHYTPSVAYPWSPEAHPLICGPPGLDKRLLPETPGPCYSNSQPVWLCLTPRQPLEPHPPGEGPSEWSSDTAEGRPCPYPHCQVLSAQPGSEEELEELCEQAV

SEQ ID NO: 396 - protein, 45 aa, Homo sapiens [sequence omitted]

SEQ ID NO: 397 - protein, 43 aa, Homo sapiens
ERLSHCRSLVMLALISLCTPCTHAFSPVFYQASVSCITLKCDH

SEQ ID NO: 398 - protein, 64 aa, Homo sapiens
WIKRILIHIFKLLSREVVKQQSMRASISLPLLGDACPHLPMYPMHSCLLSCFLSSLSFMYYTKM

SEQ ID NO: 399 - protein, 77 aa, Homo sapiens
HIKIEFFGQNFWEAMHPTWADIQPELFSRGEWYWQFMAEIHSDWLESMLYQLLNILSITLAYCYYYISSIYRQKGHF

SEQ ID NO: 400 - protein, 48 aa, Homo sapiens
SSLGKTFGKQCILHGLIFSLSCSQEESGTGSLWLKSILIGWSLCYTSC

SEQ ID NO: 401 - protein, 48 aa, Homo sapiens [sequence omitted]

SEQ ID NO: 402 - protein, 70 aa, Homo sapiens
EQLRLNISPCRMHCFPKVLPKELYFYVLSHRTGEKCSGHCWDLIFLGMGSGLMILATGVQENGSPGSDSW

SEQ ID NO: 403 - protein, 63 aa, Homo sapiens [sequence omitted]

SEQ ID NO: 404 - protein, 71 aa, Homo sapiens
MGITHECVILLGASANSLTVVPSLTLPVHHLRRLDPSLTSPFLKPVSFSLLPNWLWLFLQPFHSRAIFAKE

SEQ ID NO: 405 - protein, 63 aa, Homo sapiens
LGDHIYNWDVNHFFSGIRAQRHNLQGHIIYYEHFTVRLFILPSTCAEMKPKQAVGFHKSIYVG

SEQ ID NO: 406 - protein, 88 aa, Homo sapiens [sequence omitted]

SEQ ID NO: 407 - protein, 296 aa, Homo sapiens
LTVVYTVFYALLFVFIYVQLWLVLRYRHKRLSYQSVFLFLCLFWASRRTVLFSFYFKDFVAANSLSPFVFWLLYCFPVCLQFFTLTLMNLYFTQVIFKAKSKYSPELLKYRLPLYLASLFISLVFLLVNLTCAVLVKTGNWERKVIVSVRVAINDTLFVLCAVSLSICLYKISKMSLANIYLESKGSSVCQVTAIGVTVILLYTSRACYNLFILSFSQNKSVHSFDYDWYNVSDQADLKNQLGDAGYVLFGVVLFVWELLPTTLVVYFFRVRNPTKDLTNPGMVPSHGFSPQILFL

SEQ ID NO: 408 - protein, 152 aa, Homo sapiens
HRRLHRVLRAALRVHLRAALAGAALPPQAAQLPERLPLSLPLLGLPADRPLLLLLQRLRGGQFAQPLRLLAALLLPCVPAVFHPHADELVLHAGDFQSQVKIFSRITQIPVAPLPGLPLHQPCFPVGEFNLCCAGKDGKLGEEGYRLCASGH

SEQ ID NO: 409 - protein, 100 aa, Homo sapiens
LGFENHLREVQVHQREGEKLQAHREAVEQPEDEGAERIGRHEVFEVEGEEDGPPGGPEEAEKEEDALVAEPLVAVTQHQPELHVDEHEEQRVEHGVDDGE

SEQ ID NO: 410 - protein, 268 aa, Homo sapiens
APISSNFCSESIWGYCDQLKVSESTHVLQPFLPSILDGLIHLAAQFSSEVLNLVMETLCIVCTVDPEFTASMESKICPFTIAIFLKYSNDPVVASLAQDIFKELSQIEACQGPMQMRLIPTLVSIMQAPADKIPAGLCATAIDILTTVVRNTKPPLSQLLICQAFPAVAQCTLHTDDNATMQNGGECLRAYVSVTLEQVAQWHDEQGHNGLWYVMQVVSQLLDPRTSEFTAAFVGAFVSTLISKAGRELGENLDQISSCHPSVKMAGG

SEQ ID NO: 411 - protein, 97 aa, Homo sapiens; identical to SEQ ID NO: 384

SEQ ID NO: 412 - protein, 77 aa, Homo sapiens
PPAILTEGWHEEIWSRFSPSSRPALEMRVETKAPTKAAVNSEVRGSRSWLTTCITYHSPLWPCSSCHWATCSRVTDT

SEQ ID NO: 413 - protein, 62 aa, Homo sapiens
IGFASIPPRISGSPSILLAFYPHPPSPKLGPVLLCARETPKFRRKSIFYRGGFILDQKNKKN

SEQ ID NO: 414 - protein, 65 aa, Homo sapiens [sequence omitted]

SEQ ID NO: 415 - protein, 94 aa, Homo sapiens [sequence omitted]

SEQ ID NO: 416 - protein, 83 aa, Homo sapiens
GRRNDQLNLHIPQAGPFAGPYRLGWPLLSSGIRLPDWLVLHVSIKLKVIPWPPPGENQPHPASWGQWGRDFGLSEQLLEAAHD

SEQ ID NO: 417 - protein, 93 aa, Homo sapiens
RRKASIIAFKGILLTLTQGVQSAREPILISSSKMFLEENPWNVLKDVSGVRSSMWLAKGHLYLFQLEFINSCSLVSLGAEVWHIFKPVHSRIQ

SEQ ID NO: 418 - protein, 96 aa, Homo sapiens
TLNPHKTLSAKKARVIFFCIQDSTANLVFCYKNLVSHFLLKRTRITGTHPQLHETPSFLNEHESIYVHPSTHMKMLCSSTGMDGIRIKPIWKLKYF

SEQ ID NO: 419 - protein, 68 aa, Homo sapiens [sequence omitted]

SEQ ID NO: 420 - protein, 60 aa, Homo sapiens
KPSIHFFFSCTKTIIFLYFSWSGKRRVEKKGRMQSVTLNFSFTTHVGVHSCQQPPCTGPR

SEQ ID NO: 421 - protein, 52 aa, Homo sapiens
DAGCRFVAPALSGSPEITPQRQLPFVNTRQAVLAGPTRPHSFFHLGPVHGGC

SEQ ID NO: 422 - protein, 52 aa, Homo sapiens
VLGKSSMSITIVWKANLHPKQIEVSQVKPHRMANRCLGCRMQVRGPGPVWLP

SEQ ID NO: 423 - protein, 59 aa, Homo sapiens
YRYVFPTTHYGYNGVELQTVKFCFGLVSPDPPRQELPLPPYLPALKLCPIKLDTNLTGF

SEQ ID NO: 424 - protein, 79 aa, Homo sapiens [sequence omitted]

SEQ ID NO: 425 - protein, 102 aa, Homo sapiens
HKKTSSYSGVTVCSYDSIIRLKAGEICVQFNRTQLKGRQVGWERKLLSGGIRGNQSKTKFYCLQFNSIIAIMCSGKHIPVLLDRVSFPFSGTKMVEGIINPT

SEQ ID NO: 426 - protein, 81 aa, Homo sapiens
SMPFQFGTQPRRFPVEGGDSSIELEPGLSSSAACNGKEMSPTRQLRRCPGSHCLTITDVPVTVYATTRKPPAQSSKEMHPK

SEQ ID NO: 427 - protein, 62 aa, Homo sapiens
GRASALACHRYRSDWASGLYILAALSTSSSIGSSGGRGNWQQVGNYVKESPDVIISGCHRNI

SEQ ID NO: 428 - protein, 100 aa, Homo sapiens
REHQLLSGNDFQGTSGVAWLVTSPSHYRQHWSSAQVPAQLKNLLLPLETSLAGFQIEKAYFTENQKRLSLIPVEVNKSMLSTGLSTEGWNCQRNDDQMFR

SEQ ID NO: 429 - protein, 40 aa, Homo sapiens
NSHLNVTLIIIMLIFSISYRNQSLLKLHRGLKNVYHSIFI

SEQ ID NO: 430 - protein, 31 aa, Homo sapiens
GGIGYKGRYLNSSNNGYNPFFHNHLGCFKAI

SEQ ID NO: 431 - protein, 53 aa, Homo sapiens
TLIPIRDAKNQHNYYQCHIQVGILPNTTIKGRIKLDNKIKKYKAFKNLTHHLK

SEQ ID NO: 432 - protein, 31 aa, Homo sapiens
IALKHPKWLWKKGLYPLFELFRYLPLYPIPP

SEQ ID NO: 433 - protein, 85 aa, Homo sapiens
CNIFQWGPSEHTCWTVQTISSPEGKYFCIRGNSVLERNMFFISQIKTLSNGKLASNFFKYSIFFSPLVVTGFYRSSYTVCFNSGP

SEQ ID NO: 434 - protein, 81 aa, Homo sapiens
LLIREINQVFPLIYDAIYFSGGLQSTPVGRCKPYLLQKANTFVSEETQFWRGICSLYLKSKLSLMVNWLLIFLSTVFFFPL

SEQ ID NO: 435 - protein, 95 aa, Homo sapiens
YKSICLLEKIWFAPSNRCALKAPTEIYCIIDEGKDLVNFSYQKLVFRTSCPTWLPGAQGFFSEIVLRDPQTCSPSPGATCASSPRRQAVRSMRLS

SEQ ID NO: 436 - protein, 81 aa, Homo sapiens
SCAFLLLWGHSGPTWASMDPGLEQAHLHLFHLRQCGSRCQEGLTSGPSRFLCARNERPGPILPPRLDPEVRAGQPSRKHTV

SEQ ID NO: 437 - protein, 94 aa, Homo sapiens [sequence omitted]

SEQ ID NO: 438 - protein, 91 aa, Homo sapiens [sequence omitted]

SEQ ID NO: 439 - protein, 456 aa, Homo sapiens
ITKTHKVDLGLPEKKKKKKVVKEPETRYSVLNNDDYFADVSPLRATSPSKSVAHGQAPEMPLVKKKKKKKKGVSTLCEEHVEPETTLPARRTEKSPSLRKQVFGHLEFLSGEKKNKKSPLAMSHASGVKTSPDPRQGEEETRVGKKLKKHKKEKKGAQDPTAFSVQDPWFCEAREARDVGDTCSVGKKDEEQAALGQKRKRKSPREHNGKVKKKKKIHQEGDALPGHSKPSRSMESSPRKGSKKKPVKVEAPEYIPISDDPKASAKKKMKSKKKVEQPVIEEPALKRKKKKERESGVAGDPWKEETDTDLEVVLEKKGNMDEAHIDQVRRKALQEEIDRESGKTEASETRKWTGTQFGQWDTAGFENEDQKLKFLRLMGGFKNLSPSFSRPASTIARPNMALGKKAADSLQQNLQRDYDRAMSWKYSRGAGLGFSTAPNKIFYIDRNASKSVKLED

SEQ ID NO: 440 - protein, 125 aa, Homo sapiens
VRVCFLLPRVSCYPTLSLLLFLPFQSWLLDDWLLYLLFGLHLFLCGGLRVITYGDVFRSLNFDWLLFTSFPRAALHGPGGLGVAWEGISLLVDFFFLLHLPIVFSGALPLPFLPQGCLFLILLPH

SEQ ID NO: 441 - protein, 381 aa, Homo sapiens [sequence omitted]

SEQ ID NO: 442 - protein, 43 aa, Homo sapiens
DHHNKLSLQSQTYYILLSVNGEKISPYVLWVKCCNRLGLSNLP

SEQ ID NO: 443 - protein, 45 aa, Homo sapiens
MVISIFPPLLYKLIFTHLLLYKLTFINTNKRLVLSQFICHEPRNN

SEQ ID NO: 444 - protein, 40 aa, Homo sapiens
GKPKNCCDFFQGKLDNPNLLQHFTHKTYGLIFSPLTDSSI

SEQ ID NO: 445 - protein, 78 aa, Homo sapiens
GVGGGALRSAALPWRTLPLTSTCSRCTKPSTAEMEHLVQSWCLLNILMLQTHDFKWPLQRRSVNKSWNPLMMKCLQLI

SEQ ID NO: 446 - protein, 125 aa, Homo sapiens
RLRRRGWRSPFGGAPMAHITINQYLQQVYEAIDSRDGASCAELVSFKHPHVANPRLQMASPEEKCQQVLEPPYDEMFAAHLRCTYAVGNHDFIEAYKCQTVIVQSFLRAFQAHKEENWALLSCMQ

SEQ ID NO: 447 - protein, 80 aa, Homo sapiens
MSCKHFIIRGFQDLLTLLLWRGHLKSWVCNMRMFKRHQLCTRCSISAVDGFVHLLQVLVNGNVRHGSAAERRAPPPTPQA

SEQ ID NO: 448 - protein, 67 aa, Homo sapiens
RSRGFSCVQTPCHFREVTQACVISLWQQVGGLPQGRRWPEMCFRSLTHHSLHTRREHHSWSILRMEI

SEQ ID NO: 449 - protein, 60 aa, Homo sapiens
PITPYTHDVNTTPGAFSEWRFEFHVAASHTQTCHHSPHTHSRHSTAMSQKKFLVSDLKVL

SEQ ID NO: 450 - protein, 67 aa, Homo sapiens
RATSGRSGFIKPSNLKQGTSFGSWLLNVVSGCVGNDGRFVCEKLPHGIQISILRMLQEWCSRRVCRE

SEQ ID NO: 451 - protein, 111 aa, Homo sapiens
SASHPESRLCRGGADMQAPRGTLVFALVIALVPVGREPSSQGSQSALQTYELGSENVKVPIFEEDTPSVMEIEMEELDKWMNSMNRNADFECLPTLKEEKESNHNPSDSES

SEQ ID NO: 452 - protein, 51 aa, Homo sapiens
EEWALEETAKGSCVYVDLKLIKFVSSSSSVGSLSRLPQGLLLLENMSAIQV

SEQ ID NO: 453 - protein, 59 aa, Homo sapiens
FDSFSSFKVGKHSKSAFLFMLFIHLSSSSISISITEGVSSSKIGTFTFSLPSSYVCKAL

SEQ ID NO: 454 - protein, 107 aa, Homo sapiens
PITTCSLGDPGKDKYTCTHRGRERCVQRICINILFSHPDMRSQCCMMKRWYDSTYVPIVLLFLYFLFRSFTIGRFQKHSFHHHLEMVCLNGDNSRSCSISSRHGLLI

SEQ ID NO: 455 - protein, 73 aa, Homo sapiens [sequence omitted]

SEQ ID NO: 456 - protein, 67 aa, Homo sapiens [sequence omitted]

SEQ ID NO: 457 - protein, 81 aa, Homo sapiens
DQPSLPFIRHKTLNLTSMATKIIGSPETKWIDATSGIYNSEKSSNLSVTTDFSESLQSSNIESKEINGIHDESNAFESKAS

SEQ ID NO: 458 - protein, 41 aa, Homo sapiens [sequence omitted]

SEQ ID NO: 459 - protein, 36 aa, Homo sapiens
IPEVASIHFVSGEPIILVAILVRLRVLCRINGREGW

SEQ ID NO: 460 - protein, 36 aa, Homo sapiens
NSEGFRRNQLLQIDLKIFLSCKFQKLHQSTLFQVNL

SEQ ID NO: 461 - protein, 83 aa, Homo sapiens; identical to SEQ ID NO: 416

SEQ ID NO: 462 - protein, 93 aa, Homo sapiens; identical to SEQ ID NO: 417

SEQ ID NO: 463 - protein, 96 aa, Homo sapiens; identical to SEQ ID NO: 418

SEQ ID NO: 464 - protein, 76 aa, Homo sapiens
NLFTMKFLPEFSPFDTNSMHVSTFETQPNVISVKSSLSLPSSNLPSPRVYLPFCAHLSYSSMLFYNCDSPGSLGAI

SEQ ID NO: 465 - protein, 59 aa, Homo sapiens [sequence omitted]

SEQ ID NO: 466 - protein, 40 aa, Homo sapiens
HATVTQMCTKWQVNSRRRQITAWKTQGRFYRNDIWLSLEG

SEQ ID NO: 467 - protein, 41 aa, Homo sapiens
IPLQRFSLLTSLFFVLKLDFLVVHASLSLVTVNNLPTSSNQ

SEQ ID NO: 468 - protein, 65 aa, Homo sapiens [sequence omitted]

SEQ ID NO: 469 - protein, 56 aa, Homo sapiens
PDWLFVNTFPNKEGKGDVSYSGGKCSFSGKNGCRVGNQGSRCELLIRTGGKVVHSN

SEQ ID NO: 470 - protein, 109 aa, Homo sapiens
ARPAPAGREGRGEGEATSRRCGVGHRAGPREPAPHGAAAVRPTPGPHHHCAALSGAENYRSRHAMKLASALRRGPALHPLPPRANRGREPWRRRHRPRGWAAASRTWRS

SEQ ID NO: 471 - protein, 399 aa, Homo sapiens [sequence omitted]

SEQ ID NO: 472 - protein, 96 aa, Homo sapiens
RSAGGFSMMVTSVTPGEDSRMRVMPRVSFSRCGLLQPSPGDDASSSMARDRDSRAAGAGGGPDPASAPRPISWHAGNGSSRRLKARRSDDGGPGLV

SEQ ID NO: 473 - protein, 56 aa, Homo sapiens [sequence omitted]

SEQ ID NO: 474 - protein, 37 aa, Homo sapiens
WIFRVCCISREIHFYILFYYKHLDKGHLTHFKKHKCI

SEQ ID NO: 475 - protein, 33 aa, Homo sapiens
PKGLSIKVRRNLDTRRKRCRLLNFIIHHIHCQI

SEQ ID NO: 476 - protein, 80 aa, Homo sapiens [sequence omitted]

SEQ ID NO: 477 - protein, 48 aa, Homo sapiens; identical to SEQ ID NO: 400

SEQ ID NO: 478 - protein, 70 aa, Homo sapiens; identical to SEQ ID NO: 402

SEQ ID NO: 479 - protein, 400 aa, Homo sapiens
PQQTPWAVAGRWCNGPSLHRNRAGLDLPTIDTGYDSQPQDVLGIRQLERPLPLTSVCYPQDLPRPLRSREFPQFEPQRYPACAQMLPPNLSPHAPWNYHYHCPGSPDHQVPYGHDYPRAAYQQVIQPALPGQPLPGASVRGLHPVQKVILNYPSPWDQEERPAQRDCSFPGLPRHQDQPHHQPPNRAGAPGESLECPAELRPQVPQPPSPAAVPRPPSNPPARGTLKTSNLPEELRKVFITYSMDTAMEVVKFVNFLLVNGFQTAIDIFEDRIRGIDIIKWMERYLRDKTVMIIVAISPKYKQDVEGAESQLDEDEHGLHTKYIHRMMQIEFIKQGSMNFRFIPVLFPNAKKEHVPTWLQNTHVYSWPKNKKNILLRLLREEEYVAPPRGPLPTLQVVPL

SEQ ID NO: 480 - protein, 225 aa, Homo sapiens [sequence omitted]

SEQ ID NO: 481 - protein, 125 aa, Homo sapiens
KQRMQSSHRLHFKARVCGGLRGRALHNRFPGGQRASRGGTEKNQPGVLPTSLSQNAVRTRPQTWPGLSDLGMNGVTREPPEGWAEAPVEEPHTLPLSAAAAGCFFYSWASCRHECSEARWAHAPS

SEQ ID NO: 482 - protein, 96 aa, Homo sapiens
VAMTAKDCSIMIALSPCLQDASSDQRPVVPSSRSRFAFSVSVLDLDLKPYESIPHQYKLDGKIVNYYSKTVRAKDNAVMSTRFKESEDCTLVLHKV

SEQ ID NO: 483 - protein, 66 aa, Homo sapiens [sequence omitted]

SEQ ID NO: 484 - protein, 109 aa, Homo sapiens
NKAFRIRESDMSPGWERRTIQNVFPGLNGHFHFKSVSSFLGHSTHFLHSLSRKLFLVLFNSMSPRGNPTSKGVKSKNIHNQRSPNTTENISIIQPSHYVQVSKTLQGKS

SEQ ID NO: 485 - protein, 66 aa, Homo sapiens
CSSIPCLQEAIPPQKGLKAKTFTTKGHPTQQKISLSFSLHIMFKFQRHCRERVRPCGELMCNLRFP

SEQ ID NO: 486 - protein, 109 aa, Homo sapiens; identical to SEQ ID NO: 470

SEQ ID NO: 487 - protein, 389 aa, Homo sapiens
AAGACGARGSGRRGSYVPEVRCGAPGGAAGTGAPRSCCCQTNPGPPSSLRRAFRRRELPFPACHEIGLGAEAGSGPPPAPAARESRSRAMEEEASSPGLGCSKPHLEKLTLGITRILESSPGVTEVTIIEKPPAERHMISSWEQKNNCVMPEDVKNFYLMTNGFHMTWSVKLDEHIIPLGSMAINSISKLTQLTQSSMYSLPNAPTLADLEDDTHEASDDQPEKPHFDSRSVIFELDSCNGSGKVCLVYKSGKPALAEDTEIWFLDRALYWHFLTDTFTAYYRLLITHLGLPQWQYAFTSYGISPQAKQWFSMYKPITYNTNLLTEETDSFVNKLDPSKVFKSKNKIVIPKKKGPVQPAGGQKGPSGPSGPSTSSTSKSSSGSGNPTRK

SEQ ID NO: 488 - protein, 96 aa, Homo sapiens; identical to SEQ ID NO: 472

SEQ ID NO: 489 - protein, 152 aa, Homo sapiens
LAAGRGKEEEMGFEDHGLPFLPLTHHTPFPPLSLSPLPKKKKKETFIMNQQGFSPYQREMWKELKKPPFVPNSTLPIFYATQTLSFWVPFLQMDLLRRIIVFHVFSPQVTKINICIYNLYYCYIFVDNTFRWCWVIYYNLNLGISFGLPQSC

SEQ ID NO: 490 - protein, 91 aa, Homo sapiens
GPWLTFPAFDPSHPISSSFPLPAAKKKKKGNVYHESTGFQSLSKRDVERAKETTLCSQLHFTHILCNTNTVLLGPFLTDGPLEKNYRIPRF

SEQ ID NO: 491 - protein, 64 aa, Homo sapiens
KWGTQRAGNFHYPILGLNLKEYIHYQELSTKAGVKLHYTWLFTIPGSPPQHDCGRPKDIPRFRL

SEQ ID NO: 492 - protein, 79 aa, Homo sapiens
RFTASRVGNEPDINTPSSMPCPPSGPVPVKAGSHFSHPQAVPKALEEPKERQEPSWELTLMTRGQLAQFPLFSWGEGTL

SEQ ID NO: 493 - protein, 100 aa, Homo sapiens [sequence omitted]

SEQ ID NO: 494 - protein, 82 aa, Homo sapiens
KGSLPPTKQGKLGQLAPGHQGQLPTWLLPFLGFFQGFGNSLGVGEVASCLHWYWPRRWAGHGGGGVNIWFISHPAGCKPLVK

SEQ ID NO: 495 - protein, 79 aa, Homo sapiens
RVPSPQLNKGNWANWPLVIKVNSQLGSCLSLGSSRALGTAWGWEKWLPAFTGTGPEGGQGMEEGVLISGSFPTLLAVNL

SEQ ID NO: 496 - protein, 88 aa, Homo sapiens
IQKVQYYTSPAAFVNGSLHSHWGTTVCMGRNSKCPHCGHWVGSAFCQGVCRNWLISVCQSDQHTKVSAIKNVASLHPPSCYSGPSNLM

SEQ ID NO: 497 - protein, 98 aa, Homo sapiens
SHTSEKRRGTREEVTPASRSSISGVKRGTVALPSWLRMRKSFLQWEEIHFSIPVQSDFMGPVLNSDCIINTIKRDSEMGSRIHWDNSKAYNTALMDPT

SEQ ID NO: 498 - protein, 83 aa, Homo sapiens
AGYTPVSSTIRQLHQITGPRVTGWRMQGSHILYGRDFGVLITLAYRNKPIPADSLTKGTPHPMTTMRALAVSAHAHSCTPMAV

SEQ ID NO: 499 - protein, 85 aa, Homo sapiens [sequence omitted]

SEQ ID NO: 500 - protein, 98 aa, Homo sapiens
SYRLKGIGKCVFSRDHVESEQCWQTLPRKSCFSRCPCFGISFLGRKKKSSLTIVNSISYFSFCCSNGFPPTIIPSIYVLLYSPLSPVTFLSNTPFPKF

SEQ ID NO: 501 - protein, 87 aa, Homo sapiens
VSSCTSNHGVRSSLSSGEHKCTERDVLRVTTKELPSLSLTQAMCTCDAAECAGVGGGHVAPPEHFLTGKLGDPLLVNFVEIRTVSFT

SEQ ID NO: 502 - protein, 53 aa, Homo sapiens [sequence omitted]

SEQ ID NO: 503 - protein, 91 aa, Homo sapiens [sequence omitted]

SEQ ID NO: 504 - protein, 59 aa, Homo sapiens
VFIYDSLIIPTSISSVHTVCQMFHAEPVSRILLSDYGGFTTRPGSNSLGSKVGHSSMHR

SEQ ID NO: 505 - protein, 72 aa, Homo sapiens [sequence omitted]

SEQ ID NO: 506 - protein, 102 aa, Homo sapiens
SILGPGLCTHFIEEMKYSEVFWLPFHFNCVLNLSDHTYIVLLGAVVSFIKPLACVQKFLKGNTSNAYPLLACYAACFTAIAVCFTVFVKIPLSPFLVTGKAC

SEQ ID NO: 507 - protein, 68 aa, Homo sapiens
NNEHKMLFIITSICEISYCKTTTGLLLNSLVIVFRLEMPPTLVINITKYNVFLGRHFIKCIMPWLLLR

SEQ ID NO: 508 - protein, 65 aa, Homo sapiens
LKFLQVLKFFFYSLHWIYVFLIPNMFNWDVCHSRAARQTFKSNSHTAELAFLLTQKFRKLTVTVT

SEQ ID NO: 509 - protein, 78 aa, Homo sapiens
GPRAHWPLPNTMLEPKRANMGPEYNGDIFMFQPFNLTCLLLSFPPISSNLFCLTIYYLLGITSSYRIPSSLMSCPKQY

SEQ ID NO: 510 - protein, 63 aa, Homo sapiens
SLKLLGFLDVENTPCARHSILYGSLGSVVAGFGHFLFTSEYLYFLFLYVLKKAFLYIMNYFFF

SEQ ID NO: 511 - protein, 53 aa, Homo sapiens [sequence omitted]

SEQ ID NO: 512 - protein, 43 aa, Homo sapiens [sequence omitted]

SEQ ID NO: 513 - protein, 37 aa, Homo sapiens
QALQQIYRQTLTDTGQFSLLRNFLVLSWVTILQNFTT

SEQ ID NO: 514 - protein, 228 aa, Homo sapiens
TGGARARRPLSAVARPARSSDPLRSAPLGPAPPVNMIRCGLACERCRWILPLLLLSAIAFDIIALAGRGWLQSSDHGQTSSLWWKCSQEGGGSGSYEEGCQSLMEYAWGRAAAAMLFCGFIILVICFILSFFALCGPQMLVFLRVIGGLLALAAVFQIISLVIYPVKYTQTFTLHANRAVTYIYNWAYGFGWAATIILIGCAFFFCCLPNYEDDLLGNAKPRYFYTSA

SEQ ID NO: 515 - protein, 94 aa, Homo sapiens
DPLPPPSWEHFHHSEDVWPWSLDCNQPRPASAMMSKAMALSRSRGRIQRQRSQARPQRIMLTGGAGPSGAERSGSEERAGRATAESGLRARAPP

SEQ ID NO: 516 - protein, 208 aa, Homo sapiens [sequence omitted]

SEQ ID NO: 517 - protein, 204 aa, Homo sapiens
PSCPPEMKKELPVDSCLPRSLELHPQKMDPKRQHIQLLSSLTECLTVDPLSASVWRQLYPKHLSQSSLLLEHLLSSWEQIPKKVQKSLQETIQSLKLTNQELLRKGSSNNQDVVTCDMACKGLLQQVQGPRLPWTRLLLLLLVFAVGFLCHDLRSHSSFQASLTGRLLRSSGFLPASQQACSKFTPTVCKVTGWLGEKCRFGVP

SEQ ID NO: 518 - protein, 90 aa, Homo sapiens
PEVMAQEAYSEDQQQQEEPRPGQPRTLNLLQQALAGHVTGDDILVVTATLPQQLLVGKLEGLNGFLQRLLYLLGNLLPGAEQVLQQKAGL

SEQ ID NO: 519 - protein, 76 aa, Homo sapiens [sequence omitted]

SEQ ID NO: 520 - protein, 355 aa, Homo sapiens
FRHSMNGCEKDSSSTDSANEKPALIPREKKISILEEPSKALRGVTGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQARCRTPREGQGPFRG

SEQ ID NO: 521 - protein, 120 aa, Homo sapiens [sequence omitted]

SEQ ID NO: 522 - protein, 116 aa, Homo sapiens [sequence omitted]

SEQ ID NO: 523 - protein, 130 aa, Homo sapiens
RRQRKAEPGACALGRVGSECIPEPGARRTAQAAGLRSVSGAANTKVRELKHFRFLGLLRSCRSEMEVDAPGVDGRDGLRERRGFSEGGRQNFDVRPQSGANGLPKHSYWLDLWLFILFDVVVFLFVYFLP

SEQ ID NO: 524 - protein, 78 aa, Homo sapiens
ISANKSWQKIHKEKHHHIEKDEKPEVQPVGVFGKPICPRLRPHIEVLPPSLAKASPLPETISTINTRCVHLHLAPAAS

SEQ ID NO: 525 - protein, 95 aa, Homo sapiens
GLTSKFCLPPSLKPRRSRRPSRPSTPGASTSISLLQLRNNPRNRKCLSSRTLVFAAPETERSPAACAVRRAPGSGMHSEPTLPSAQAPGSAFRCL

SEQ ID NO: 526 - protein, 112 aa, Homo sapiens
SLNSTFSVLPQKFPQFQQHRAVYNSFSFPGQAARYPWMAFPRNSIMHLNHTANPTSNSNFLDLNLPPQHNTGLGGIPVAGEEEVKVSTMPLSTSSHSLQQGQQPTSLHTTVA

SEQ ID NO: 527 - protein, 72 aa, Homo sapiens
RFRPCHCQPLPIHYNKDSSLQVSTLLWPDNRTERRGLDSGVLAWATGFLHDSFMILLLMYTPRRANINVPHA

SEQ ID NO: 528 - protein, 102 aa, Homo sapiens
RNHAKIQLPMQAPQSLILSSQFCCQATVVWRLVGCCPCCNEWEEVDSGMVETFTSSSPATGIPPRPVLCCGGRFKSKKLLFEVGFAVWFKCMMLLRGKAIQG

SEQ ID NO: 529-530 - skipped (2 entries)

SEQ ID NO: 531 - DNA, 1708 bp, Homo sapiens
cctggaaacaagatccaaacccaagtgaccccgccggaaagtgacccagtcaggtttaaaaattccaacaaaccgacgtgaacaaatagaccgaccaaccaaatatacaatccgtcaaaatacattcacttccactacgaaaccccaacaaagggtgtgaatgcccgcccaggagagacggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgaaaagttgg

SEQ ID NO: 532 - DNA, 2128 bp, Homo sapiens
ctgtatcctaatttcttggtgaatgaactcattcttaaacagaagcaaagatttgaggaaaagaggttcaaattggaccactcagtgagtagcaccaatggccacaggtggcagatatttcaagattggttgggaactgaccaagataaccttgatttggccaatgtcaatcttatgttggagttactagtgcagaagaagaaacaactggaagcagaatcacatgcagcccaactacagattcttatggaattcctcaaggttgcaagaagaaataagagagagcaactggaacagatccagaaggagctaagtgttttggaagaggatattaagagagtggaagaaatgagtggcttatactctcctgtcagtgaggatagcacagtgcctcaatttgaagctccttctccatcacacagtagtattattgattccacagaatacagccaacctccaggtttcagtggcagttctcagacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatgaagggttaactcaagtcaaattgtacttgatcctgctgaaatacatctgcagctgacaatgagagaagaaacagaaaatgtcatgtgatgtctctccccaaagtcatcatgggttttggatttgttttgaatatttttttctttttttcttttccctcctttatgacctttgggacattgggaatacccagccaactctccaccatcaatgtaactccatggacattgctgctcttggtggtgttatctaatttttgtgatagggaaacaaattcttttgaataaaaataaataacaaaacaataaaagtttattgagccacaaaaaaaaaaaaaaaaaaaaaaaaaaaaaacaaaagagaaaacaaaggttacgaagtagcatatgtgaactataatgtaacagtgaataatttgtaaagttcgtatttcccaacctctttgggaattacacatatcaatataaacaaaatataaagt

SEQ ID NO: 533 - DNA, 2640 bp, Homo sapiens
ctagcaagcaggtaaacgagctttgtacaaacacacacagaccaacacatccggggatggctgtgtgttgctagagcagaggctgattaaacactcagtgtgttggctctctgtgccactcctggaaaataatgaattgggtaaggaacagttaataagaaaatgtgccttgctaactgtgcacattacaacaaagagctggcagctcctgaaggaaaagggcttgtgccgctgccgttcaaacttgtcagtcaactcatgccagcagcctcagcgtctgcctccccagcacaccctcattacatgtgtctgtctggcctgatctgtgcatctgctcggagacgctcctgacaagtcgggaatttctctatttctccactggtgcaaagagcggatttctccctgcttctcttctgtcacccccgctcctctcccccaggaggctccttgatttatggtagctttggacttgcttccccgtctgactgtccttgacttctagaatggaagaagctgagctggtgaagggaagactccaggccatcacagataaaagaaaaatacaggaagaaatctcacagaagcgtctgaaaatagaggaagacaaactaaagcaccagcatttgaagaaaaaggccttgagggagaaatggcttctagatggaatcagcagcggaaaagaacaggaagagatgaagaagcaaaatcaacaagaccagcaccagatccaggttctagaacaaagtatcctcaggcttgagaaagagatccaagatcttgaaaaagctgaactgcaaatctcaacgaaggaagaggccattttaaagaaactaaagtcaattgagcggacaacagaagacattataagatctgtgaaagtggaaagagaagaaagagcagaagagtcaattgaggacatctatgctaatatccctgaccttccaaagtcctacataccttctaggttaaggaaggagataaatgaagaaaaagaagatgatgaacaaaataggaaagctttatatgccatggaaattaaagttgaaaaagacttgaagactggagaaagtacagttctgtcttccaatacctctggccatcagatgactttaaaaggtacaggagtaaaagtttaagatgatgggcaaaagtccagtgtattcagtaaagtgctaatcacaagttggaggtcaatggcaccgatggcctggcaccagttgaagtagaggaacttctaagacaagcctcagagagaaactctaaatccccaacagagtatcatgagcctgtatatgccaatcccttttacaggcctacaaccccacagagagaaacggtgacccctggaccaaactttcaagaaaggataaagattaaaactaatggactgggtattggtgtaaatgaatccatacacaatatgggcaatggtctttcagaggaaaggggaaacaacttcaatcacatcagtcccattccgccagtgcctcatccccgatcagtgattcaacaagcagaagagaagcttcacaccccgcaaaaaaggctaatgactccttgggaagaatcgaatgtcatgcaggacaaagatgcaccctctccaaagccaaggctgagccccagagagacaatatttgggaaatctgaacaccagaattcttcacccacttgtcaggaggacgaggaagatgtcagatataatatcgttcattccctgcctccagacataaatgatacagaaccggtgacaatgattttcatggggtatcagcaggcagaagacagtgaagaagataagaagtttctgacaggatatgatgggatcatccatgctgagctggttgtgattgatgatgaggaggaggaggatgaaggagaagcagagaaaccgtcctaccaccccatagctccccatagtcaggtgtaccagccagccaaaccaacaccacttcctagaaaaagatcagaagctagtcctcatgaaaacacaaatcataaatccccccacaaaaattccatatctctgaaagagcaagaagaaagcttaggcagccctgtccaccattccccatttgatgctcagacaactggagatgggactgaggatccatccttaacagctttaaggatgagaatggcaaagctgggaaaaaaggtgatctaagagttgtaccacctatataaacatcctttgaagaagaaactaagaagcatttgcaaatttctcttctggatattttgtttattttttctgaagtccaaaaaattatcattacagtgtaccatattaagccatgtgaataagtagtagtcattatttgtgaaaaattcccaaaaagctggggaaaacaaatgtgtaacttttccagttacttgacacgattcagtgggggaaaaccagcattttttattctattgataccaaagcatttctaataagagcttgttaaatttaagaataaagttatttaaaatattctgagtatagtatattaactggcattgtaattttgatgatacaaagattgaaagatcataggaaagcattgcccttcatcacagaagtattcaactctgacaaataaatatgtcatcctgaattaataatgccttaataaaagtacatcctcctgctaaaaa

SEQ ID NO: 534 - DNA, 1245 bp, Homo sapiens
tgcagcgcgtgcgtgctgcgctactgagcagcgccatggaggactctgaagcactgggcttcgaacacatgggcctcgatccccggctccttcaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcgacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagagagctgtgctgatggagaagccagatgtggtagtagggaccccatctcgcatattaagccacttgcagcaagacagcctgaaacttcgtgactccctggagcttttggtggtggacgaagctgaccttcttttttcctttggctttgaagaagagctcaagagtctcctctagtcacttgccccggatttaccaggcttttctcatgtcagctacttttaacgaggacgtacaagcactcaaggagctgatattacataacccggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccaggtgccacatcatctcacagttcaaccaaggcttctacgactgtgtcatagcaactgatgctgaagtcctgggggccccacgtcaacgggcaatgcgaccccggcgacgagccaaaacggggacaatggcctctcgattcctggaacgcacggtcgtggccctggggcactagaccttccaccatcgtgtctgcatgtgctcaacttttgatcttcccccccaacccctgaggcctaacatccatcgagcttggcaggacagcaacgcgctaacaacccagggcataggtcttaacctttggtgctttcccacggaggcg

SEQ ID NO: 535 - DNA, 822 bp, Homo sapiens
  modified_base (53)..(54): a, t, c, g, other or unknown
  modified_base (265): a, t, c, g, other or unknown
aagatcggtctttgtccttatccttatccttattctaatggcagttagatgcnnttctttagagggggcaatgagacagccaggtgggaaggggtccccagagaaactccagcctgcacactgggaggagtgtgcactggggtgaagccaccggaagtttgcgccatctccagtggggaagagcccagcccctcctcttcctgggtgggaaactgcgattcaaactgccaggtgggaagtccatgggcaggaaacaggctctcgntttgctaagagtctctgtttcccccttttttcctttatgcctaattaataaattccatttttctcacccttcaaacagcctgtgagcctaaatttttgtggccatgggacagacaaggaccccgtcttcagctgaactaaggagaaagtccccaaacaatgggaagaaaggcagggagtagacatccaatttcctggcgtggattgtggaggggtaccatggttctgaccagatgtgtatcaggagctgtgttgcaggaagtctcaggaatgaagttgatagctttctttccatcacatgatgactgaaaagacgaaggcatctaatgagttagagtcacaccatctcatgcctgtatactatcaaacaacttttgggaagctagccttggttgggaaaacatcatttcttaactgaatgcctggatgcaagcaaagtctcattcttgatcatgatgaggtttaccatgtcttcttgacaggatcctgcaaacaaacccacaattgctactatgacatgcaactccatggttaattccttggatagcaaatagctcg

SEQ ID NO: 536 - DNA, 2703 bp, Homo sapiens
  modified_base (224): a, t, c, g, other or unknown
  modified_base (230): a, t, c, g, other or unknown
  modified_base (245): a, t, c, g, other or unknown
  modified_base (351): a, t, c, g, other or unknown
  modified_base (369): a, t, c, g, other or unknown
  modified_base (381): a, t, c, g, other or unknown
  modified_base (4222): a, t, c, g, other or unknown
  modified_base (426): a, t, c, g, other or unknown
  modified_base (441): a, t, c, g, other or unknown
  modified_base (507): a, t, c, g, other or unknown
  modified_base (509): a, t, c, g, other or unknown
  modified_base (517): a, t, c, g, other or unknown
  modified_base (520): a, t, c, g, other or unknown
  modified_base (532): a, t, c, g, other or unknown
  modified_base (538): a, t, c, g, other or unknown
  modified_base (542): a, t, c, g, other or unknown
  modified_base (557): a, t, c, g, other or unknown
  modified_base (562): a, t, c, g, other or unknown
  modified_base (566): a, t, c, g, other or unknown
  modified_base (576): a, t, c, g, other or unknown
  modified_base (629): a, t, c, g, other or unknown
  modified_base (656): a, t, c, g, other or unknown
  modified_base (663): a, t, c, g, other or unknown
  modified_base (708): a, t, c, g, other or unknown
  modified_base (716): a, t, c, g, other or unknown
  modified_base (726): a, t, c, g, other or unknown
  modified_base (732): a, t, c, g, other or unknown
  modified_base (738): a, t, c, g, other or unknown
  modified_base (745): a, t, c, g, other or unknown
  modified_base (759): a, t, c, g, other or unknown
  modified_base (762): a, t, c, g, other or unknown
  modified_base (769): a, t, c, g, other or unknown
  modified_base (773): a, t, c, g, other or unknown
  modified_base (781): a, t, c, g, other or unknown
  modified_base (784): a, t, c, g, other or unknown
  modified_base (795): a, t, c, g, other or unknown
  modified_base (803): a, t, c, g, other or unknown
  modified_base (830)..(831): a, t, c, g, other or unknown
  modified_base (861): a, t, c, g, other or unknown
  modified_base (871): a, t, c, g, other or unknown
  modified_base (904): a, t, c, g, other or unknown
  modified_base (917): a, t, c, g, other or unknown
  modified_base (926)..(927): a, t, c, g, other or unknown
  modified_base (954): a, t, c, g, other or unknown
  modified_base (989): a, t, c, g, other or unknown
  modified_base (993): a, t, c, g, other or unknown
  modified_base (997): a, t, c, g, other or unknown
  modified_base (1014): a, t, c, g, other or unknown
  modified_base (1019): a, t, c, g, other or unknown
  modified_base (1042): a, t, c, g, other or unknown
  modified_base (1055)..(1056): a, t, c, g, other or unknown
  modified_base (1077): a, t, c, g, other or unknown
  modified_base (1086): a, t, c, g, other or unknown
  modified_base (1095): a, t, c, g, other or unknown
  modified_base (1166): a, t, c, g, other or unknown
  modified_base (1178)..(1180): a, t, c, g, other or unknown
  modified_base (1267): a, t, c, g, other or unknown
  modified_base (1271): a, t, c, g, other or unknown
  modified_base (1307): a, t, c, g, other or unknown
  modified_base (1318): a, t, c, g, other or unknown
  modified_base (1330): a, t, c, g, other or unknown
  modified_base (1349): a, t, c, g, other or unknown
  modified_base (1357): a, t, c, g, other or unknown
  modified_base (1363): a, t, c, g, other or unknown
  modified_base (1368)..(1369): a, t, c, g, other or unknown
  modified_base (1374): a, t, c, g, other or unknown
  modified_base (1383): a, t, c, g, other or unknown
  modified_base (1386): a, t, c, g, other or unknown
  modified_base (1392): a, t, c, g, other or unknown
  modified_base (1400): a, t, c, g, other or unknown
  modified_base (1408)..(1409): a, t, c, g, other or unknown
  modified_base (1415): a, t, c, g, other or unknown
  modified_base (1424): a, t, c, g, other or unknown
  modified_base (1438): a, t, c, g, other or unknown
  modified_base (1445): a, t, c, g, other or unknown
  modified_base (1448): a, t, c, g, other or unknown
  modified_base (1461): a, t, c, g, other or unknown
  modified_base (1473): a, t, c, g, other or unknown
  modified_base (1489): a, t, c, g, other or unknown
  modified_base (1495): a, t, c, g, other or unknown
  modified_base (1508): a, t, c, g, other or unknown
  modified_base (1530): a, t, c, g, other or unknown
  modified_base (1589): a, t, c, g, other or unknown
  modified_base (1597): a, t, c, g, other or unknown
  modified_base (1650): a, t, c, g, other or unknown
  modified_base (1720)..(1721): a, t, c, g, other or unknown
  modified_base (1780): a, t, c, g, other or unknown
  modified_base (1857): a, t, c, g, other or unknown
  modified_base (1864): a, t, c, g, other or unknown
  modified_base (1868): a, t, c, g, other or unknown
  modified_base (1909): a, t, c, g, other or unknown
  modified_base (1925): a, t, c, g, other or unknown
  modified_base (1937): a, t, c, g, other or unknown
  modified_base (1957): a, t, c, g, other or unknown
  modified_base (1960): a, t, c, g, other or unknown
  modified_base (1975): a, t, c, g, other or unknown
  modified_base (2010): a, t, c, g, other or unknown
  modified_base (2022): a, t, c, g, other or unknown
  modified_base (2040): a, t, c, g, other or unknown
  modified_base (2053): a, t, c, g, other or unknown
  modified_base (2059): a, t, c, g, other or unknown
  modified_base (2068): a, t, c, g, other or unknown
  modified_base (2091)..(2092): a, t, c, g, other or unknown
  modified_base (2101): a, t, c, g, other or unknown
  modified_base (2105): a, t, c, g, other or unknown
  modified_base (2130): a, t, c, g, other or unknown
  modified_base (2145): a, t, c, g, other or unknown
  modified_base (2148): a, t, c, g, other or unknown
  modified_base (2152): a, t, c, g, other or unknown
  modified_base (2157): a, t, c, g, other or unknown
  modified_base (2164): a, t, c, g, other or unknown
  modified_base (2167): a, t, c, g, other or unknown
  modified_base (2178): a, t, c, g, other or unknown
  modified_base (2184): a, t, c, g, other or unknown
  modified_base (2194): a, t, c, g, other or unknown
  modified_base (2210): a, t, c, g, other or unknown
  modified_base (2246): a, t, c, g, other or unknown
  modified_base (2250): a, t, c, g, other or unknown
  modified_base (2265): a, t, c, g, other or unknown
  modified_base (2270): a, t, c, g, other or unknown
  modified_base (2274): a, t, c, g, other or unknown
  modified_base (2289): a, t, c, g, other or unknown
  modified_base (2317): a, t, c, g, other or unknown
  modified_base (2320): a, t, c, g, other or unknown
  modified_base (2327): a, t, c, g, other or unknown
  modified_base (2332): a, t, c, g, other or unknown
  modified_base (2336): a, t, c, g, other or unknown
  modified_base (2342): a, t, c, g, other or unknown
  modified_base (2351): a, t, c, g, other or unknown
  modified_base (2356): a, t, c, g, other or unknown
  modified_base (2359): a, t, c, g, other or unknown
  modified_base (2367)..(2368): a, t, c, g, other or unknown
  modified_base (2372): a, t, c, g, other or unknown
  modified_base (2378): a, t, c, g, other or unknown
  modified_base (2387): a, t, c, g, other or unknown
  modified_base (2396): a, t, c, g, other or unknown
  modified_base (2410): a, t, c, g, other or unknown
  modified_base (2414): a, t, c, g, other or unknown
  modified_base (2420): a, t, c, g, other or unknown
  modified_base (2422): a, t, c, g, other or unknown
  modified_base (2431): a, t, c, g, other or unknown
  modified_base (2437): a, t, c, g, other or unknown
  modified_base (2443): a, t, c, g, other or unknown
  modified_base (2448): a, t, c, g, other or unknown
  modified_base (2460): a, t, c, g, other or unknown
  modified_base (2463): a, t, c, g, other or unknown
  modified_base (2474): a, t, c, g, other or unknown
  modified_base (2477): a, t, c, g, other or unknown
  modified_base (2490): a, t, c, g, other or unknown
  modified_base (2506): a, t, c, g, other or unknown
  modified_base (2509): a, t, c, g, other or unknown
  modified_base (2512): a, t, c, g, other or unknown
  modified_base (2529): a, t, c, g, other or unknown
  modified_base (2539): a, t, c, g, other or unknown
  modified_base (2559): a, t, c, g, other or unknown
  modified_base (2599): a, t, c, g, other or unknown
  modified_base (2602): a, t, c, g, other or unknown
  modified_base (2619): a, t, c, g, other or unknown
  modified_base (2624): a, t, c, g, other or unknown
agttcggcacagggggaggaacctggccctgggaggaggctgttgcgtgctcctagagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtggngcacangctctgatgattttnagtggccattggttttaaaaccaagctggctgctttgactcttgttgtgtggctctttgccatcaacgtatatttcaacgccttctggaccattccagtctacaangcccatgcatgacttccntgaaatacgacnttcttccagaccatgtcggtgattgggggcttgctcctggntggntggccctgggccctngggggtgtctccatggatgagaagaagaaggagtggtaacagtcacagatccctacctgcctggcntnaagacccngtnggccgtcaaggnactggnttcnggggtggattcaacnaaaanctgnccagcttttnatgtatcctcttcccttcccctcccttggtaaaggcacagatgttttgagaanctttatttgcagagacacctgagaatncgatggnctcagtctgctctggagccacagtctggcgtctgacccttcagtngcaggccnagcctggcangctggnaagccntcccccnacgccgaggctttnggnagtgaancagncccgcttnggnctgtggcatcntcagtccntatttttgagtttttttgtgggggtanncaggagggggccttcaagctgtactgtgangcagacgcanttggtattatcattcaaagcagtctccctcttnatttgtaagtttnacatttttnnagcggaaactactaaattattttgggntggttcagccaaacctcaaaacagttaatctcccntggntttnaaaatcacaccagtggnctttngatgttgtttctgccccgcattngtattttataggnnaatagtgaaaacatttagggnacacccaanagaatgatngcagtattaaaggggtggtagaagctgctgtttatgataaaagtcatcggtcagaaaatcagcttggattnggtgccaagtgnnnttttattgggtaacaccctgggagttttagtagcttgaggcaaggtggaggggcaagaagtccttggggaagctgctggtctgggtngctngctggcctccaagctggcagtgggaagggctagtgnagaccacacanggggtagccccnagcagcagcaccctgcaangccagccntggccnagctnngctcnagaccagcnttngcagangccgcagnccgctgtnngggcangggggtgtnggcaggagctcccnagcactnggnagacccacggacntcaacccagttnacctcacatggggccnttttcntgagcaaggtctncgaaagcgcaggccgccctggnctgagcagcaccgccctttcccagctgcactcgccctgtggacagccccgacacaccanctttcctngaggctgtcgctcactcagattgtccgtttgctatgccgaatgcagccaaaanttcctttttacaatttgtgatgccttaccgatttgatcttaatcctgtatttaaagttttctaacactgnnccttaaactgtgtttctctttttgggggagcttaactgcttgttgctccctgtcgtctngcaccatagtaaatgccacaagggtagtcgaacacctctctggcccctagacctatctggggacaggctggctcagnctgtctnccangggctgctgcggcccagccccgagcctgcctccctcttggncctctcatccattggnctctgcagggcanggggtgaggcaggtttctngcntcataagtgcttttnggaagtcacctacctttttaacacagccgaactangtcccaacgcgntttgcaaatattcccctnggtagcctacttnccttancccccgaantattggtaagatcgagcaatggnncttcaggancatngggttctcttctcctgtgatcattncaagtgctcactgcnatngaangactnggcttgntcntcagtgtttcnaacctncaccagggcntgtctcttggtccacnacctcgctccctgttagtgccgtatgacagcccccnatcnaaatgaccttggccnaagtncacnggtttctctgtggtncaaggttggttggctgattggtggaaangtnagggtgngaccnaaanggaggnccacgtgangcagntcnagcaccanngttnctgcanccagcagcngcctccgtncctagtgggtgttncctngtttcntncctggcccntgggtngggctnagggncctgattcgggnaangatgcctttgncangggaggggaggantaagtgggatctaccnaanttngattctggcaaaacaantttctaagantttttttgctttatgtgggnaaacagatctaaatctcattttatgctgtattttatatcnttnagttgtgtttgaaaacngtttntgatttttggaaacacatcaaaataaataatggcgtttgttgtaaaaaaaaaaaaaaaaaaaaaaaaaaaaaaaaaaaa

SEQ ID NO: 537 - DNA, 2664 bp, Homo sapiens
ctcccagggagtgctgagtagtgatggtgtctggagggtcaaatccattcccaatggcaaaggttcctcaccactccccaccgctacaactccaaaaccacttatccctacagaggccagcatcagggtctggggcacgagcggcacgagccatctccatccccggagcatctgtatgattcagaagtacaaccacgatggggaagcaggtcggctggaggcttttagccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgagggggtatagacagagcatgccacacaagccacagaaccaaagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccgggtatggttctggatggttcccccaagggagcaggtcctctgtttccctctcccttccacagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctatttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactaccccctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaacggtgggaaacctcagcaggggtcttatttcccagctgctgggagatgatgttgaaggtctgtggctgtgccccttgctcctggcacatggtgaggatcacacggtcagcttcccttgtccacaggacaaccttttccccagtggagctgaccttgctgttgttggcacacaccgtagcttctgcggcctttggctgctgctccccctctggacccttggcctgtgttccactgtctttagccaaaccccctctaggggctttgggagaagtctctgaggtgtcaattcctgatggagattcatggacagggcacgtcctgtctcttgtcttcaccctagctctgcttgagggcagccatctctcttgagtgtctggtttcccggacacatgtcttctccctgcatctctggtctttgaggaaacaggactcaggaaggaagcagggggttccacggtaccaggcaatttctcagtttctgatgcatcccagaccagcatcaaagcctctgactcactcactgccttttggccctccctctctttctgaagtctgggggatgccttggggcaggagcgaacctcaggcccaacctggtttctcttaacagtgtacagtacagctccagttgtggggggaaattgaggagtctctggtgaatgaggtggtgggccatccaggaggagccgttctgta

SEQ ID NO: 538 - DNA, 3888 bp, Homo sapiens
gaattcccgcccggactgacggagcccactgcggtgcgggcgttggcgcgggcacggaggacccgggcaggcagcgcaagcgaccccgagcggagccccggagccatggccctgagcgagctggcgctggtccgctggctgcaggagagccgccgctcgcggaagctcatcctgttcatcgtgttcctggcgctgctgctggacaacatgctgctcactgtcgtggtccccatcatcccaagttatctgtacagcattaagcatgagaagaatgctacagaaatccagacggccaggccagtgcacactgcctccatctcagacagcttccagagcatcttctcctattatgataactcgactatggtcaccgggaatgctaccagagacctgacacttcatcagaccgccacacagcacatggtgaccaacgcgtccgctgttccttccgactgtcccagtgaagacaaagacctcctgaatgaaaacgtgcaagttggtctgttgtttgcctcgaaagccaccgtccagctcatcaccaaccctttcataggactactgaccaacagaattggctatccaattcccatatttgcgggattctgcatcatgtttgtctcaacaattatgtttgccttctccagcagctatgccttcctgctgattgccaggtcgctgcagggcatcggctcgtcctgctcctctgtggctgggatgggcatgcttgccagtgtctacacagatgatgaagagagaggcaacgtcatgggaatcgccttgggaggcctggccatgggggtcttagtgggcccccccttcgggagtgtgctctatgagtttgtggggaagacggctccgttcctggtgctggccgccctggtactcttggatggagctattcagctctttgtgctccagccgtcccgggtgcagccagagagtcagaaggggacacccctaaccacgctgctgaaggacccgtacatcctcattgctgcaggctccatctcctttgcaaacatgggcatcgccatgctggagccagccctgcccatctggatgatggagaccatgtgttcccgaaagtggcagctgggcgttgccttcttgccagctagtatctcttatctcattggaaccaatatttttgggatacttgcacacaaaatggggaggtggctttgtgctcttctgggaatgataattgttggagtcagcattttatgtattccatttccaaaaaacatttatggactcatagctccgaactttggagttggttttgcaaatggaatggtggattcgtcaatgatgcctatcatgggctacctcgtagacctgcggcacgtgtccgtctatgggagtgtgtacgccattgcggatgtggcattttgtatggggtatgctataggtccttctgctggtggtgctattgcaaaggcaattggatttccatggctcatgacaattattgggataattgatattctttttgcccctctctgcttttttcttcgaagtccacctgccaaagaagaaaaaatggctattctcatggatcacaactgccctattaaaacaaaaatgtacactcagaataatatccagtcatatccgataggtgaagatgaagaatctgaaagtgactgagatgagatcctcaaaaatcatcaaagtgtttaattgtataaaacagtgtttccagtgacacaactcatccagaactgtcttagtcataccatccatccctggtgaaagagtaaaaccaaaggttattatttcctttccatggttatggtcgattgccaacagccttataaagaaaaagaagcttttctaggggtttgtataaatagtgttgaaactttattttatgtatttcattttattaaatatcatacaatatattttgatgaaataggtattgtgtaaatctataaatacttgaatccaaaccaaatataattttttaacttacattaacaaacatttgggcaaaaatcatattggtaatgagtgtttaaaattaaagcacacattatctctgagactcttccaacaaagagaaactagaatgaagtctgaaaaacagaatcaagtaagacagcatgttatatagtgacactgaatgttatttaacttgtagttactatcaatatatttatgcgttaaacagctagttctctcaagtgtagaggacaagaacttgtgtcagttatcttttgaatccataaatcttagctggcattagttttctatgtaatcacctacctagagagagttgtaaattatatgttaacatgttatctggttggcagcaaacactaaagccaataaaggaaaaacagtaaatgttccgaaagcagagaaaagcaaccaaacatattgttatgaactaaaagctttccctttaagatgcatacttgtcttactggatgaagaaaattgagggtacatgtaccttatactgtcaaggttgtttaaacatgataaggttaatcgccatctacttcaagttttagaaaaggaaacaagaagctaaaaacagctgctctgactttaatatctgactatatctttgatctgtttgcaggtcatccaagtgttttctaggaatatatttattttaggttgtctgaaactactattttttagactcctgaaagttgttcacatcaatgtgaagacaaattttaaatgaaaatgaagaatgaaattatgtcttgaatcatatattaagaagtaaaaataatagtgatcaggcagaaaagaaaaatggaacatctaaaaatgtatgtgctaactatatcatccagtgtgcagtgttgtgtatttttctaagcatgacaacattgatgtgccttttcagtgtaacagcaaatactgttagtgaacattgtcaatttatgtcattttgttaagagatatgactggagtgtgcagtgtggaatgtctctaatactacttgagaatcctgcagttctataatcataaacaaaaattacttagtttcgttaagctaagattgtgtttgtgttaacttcgacatcaaggagcaaagaactttagaacagactcctcaatcttgtgactttcttattctctaggaaagtaacacttcgtttcatgaagcttttctgtggggcttcgattatttcaagtctggtttctaagtgcagtgtgtttgaagcaaacgaacttccaactcacttatttggcattgggcaacttggccaagtctgctactttggaagatggctctggaggaaactctcatatggctaaaaaggcaggctagtttcttacttctacaggggtagagccttaaaaaagaacgtgctacaaattggttctctttgagggtttctggttctccctgcccccaataccatatactttattgcaattttatttttgcctttacggctctgtgtctttctgcaagaaggcctggcaaaggtatgcctgctgttggtccctcgggataagataaaatataaataaaaccttcagaactgttttggagcaaaagatagcttgtacttggggaaaaaaattctaagttcttttatatgactaatattcttggttagcaagactggaaagaggtgtttttttaaaatgtacataccagaacaaagaacatacagctctctgaacatttattttttgaacagaggtggtttttatgtttggacctggtaatacagatacaaaaactttaatgaggtagcaatgaatattcaactgtttgactgctaagtgtatctgtccatattttagcaagtttacttaataaatcttctgaaccatgttttgtgcctgtttgtattcctttataaaccaaatgttgttggaataaaatacataaggtatcattttgaccgt

SEQ ID NO: 539 - DNA, 3304 bp, Homo sapiens
aaaccctcttggctgtctgctgtccagggagtcgccactcccttcattatagccttgctcagagtgcagcggcaggcctggggatggcctcgggagagggaccacagagcaccagcctgcatggaacttccttcctcactcagcttcccacgttgccagctgggacaggggagatggagtaattttgctgtggaaagacttcacgtcttgccgaatgaaagtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggtgatcctgacgttctttgtgggtgctgccatcctctggctgctctgctcccaccgcccggcccccggcaggccccccacccacaatgcacacaactggaggctcggccaggcgcccgccaactggtacaatgacacctaccccctgtctcccccacaaaggacaccggctgggattcggtatcgaatcgcagttatcgcagacctggacacagagccaaccgcccaagacgaaaacacctggcgcagcgacctgaaaaagggctacctgaccctgtcagacagtggggacaaggtggccgtggaatgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctgtccgacggcgacggcaccgtggagaaaggcttcaaggccgaatggctggcagtgaaggacgagcgtctgtacgtgggcggcctgggcaaggagtggacgaccactacgggtgatgtggtgaacgagaacccggagtgggtgaaggtggtgggctacaagggcagcgtggaccacgagaactgggtgtccaactacaacgccctgcgggctgctgccggcatccagccgccagctaacctcatccatgagtctgcctgctggagtgacacgctgcagcgctggttcttcctgccgcgccgcgccagccaggagcgctacagcgagaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttaactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtgagcatgaggtggacctgtttgctgggaaccccaggtcacccccttttcttcccaaacttggtgccttggaagaatcaggtccagccctgaagatccttggggaagaaaatgtttatgttgcagggtattgcatggtcacgagtgaggggcaggcccctgggggacacatctgcccacagctgcacaggccaggggcacaggcacatctgttggttctcaggcctcagataaaaccatctccgcatcatatggccagtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggttaggcacgacccaggctgagaagggacgtttccatcattcacagtgccctccccacagcaactacctcaccccgacccccaccctcactcctaccccaccccgcgatcgtcaggggtgccacggtgggccggagggtgccggctctggctgtccctgtgccggtccctcacaaacctctccccctttgaaactcaagcacagctgcgaggagggcagcgaggagggacccctctctcatggttgtctctttcccccgctatgtcataggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggagtgtaaaaaacagatggat

SEQ ID NO: 540 - DNA, 863 bp, Homo sapiens
caggattgaaacaagatggcgggttcgtggtgagaagccgtcaaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagagacctattccttttttcgttttctattttagtgtttcatttatgtgcggtctccaatttaggacttttccatagtgccaaagccatacatattcagtagaacatcaataaaaaaaaaaaa

SEQ ID NO: 541 - DNA, 1962 bp, Homo sapiens
accgacggccgccccttttcgtcttttttttttttacatttcaaatatattttattactttccatcttagaaagaatatgaaacctgcatgcaatgctaatggtttctgacatgtacatagcatataacacagcagtacaatgcggcatatactggggggcagtgtgtggagggggcgttcttaagggtatatgtacagaggaaagggcgcatggtcatcttagctttcgaaagaggactgcactgtttaacattgaagaattacatggggaatcacaaatatattgctttagtactgcatgttctgttgtggtgagggaaagaaacatgctttgaaggttttcccttgtcaacagaatgtgtgtctgtagctgtgtattgcgcatgtattcatatatttttaagttttctcctaaggtttttgctgacagtgttgggaacctcacatgcttctgaagcattaaatattgaacctgtgaacctttcagaaatcctcaggttgggaaagaccccacaccttctttaaggatcatttgtctcgccatcacaggatcttggaaatgtttcctagggtgtgtaaaaattaaccaggggggaatgaagcacatttttctggcaaccaaacttgagttcctcagagaacagatgcagagagacctgctcctgcttgcccggctacaggggccactgtggagtcacactgaggctgtgaccggccataagcccaggagagcccgtggcagctgtgccgaggcgccaggacctctaagcggaagcttcccaagctaggaatggagcaacactgcaatgaaatgtgtccaccaagctcattgttcctcccgggcgcttataaagctcagatgtatagtgacgtatggacaaatacaaaaaaaaaaaaaaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaaaaccttcaaagcatgtttctttccctcaccacaacagaacatgcagtactaaagcaatatatttgtgattccccatgtaattcttcaatgttaaacagtgcagtcctctttcgaaagctaagatgaccatgcgccctttcctctgtacatatacccttaagaacgccccctccacacactgccccccagtagtacgcaggcattggtaccggctggtgttaaaatggctatgggacatggtcaggaaaccatttaggcattggcattgagggttccataatccgtttctaagga

SEQ ID NO: 542 - DNA, 1772 bp, Homo sapiens
tgggcgctgtagtccggccggaacctgtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcgccggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaagacaaatcttcctattttcaagctgaaagaatctactgttagaagaagatacagtgactttgaatggctgcgaagtgaattagaaagagagagcaaggtcgtagttcccccgctccctgggaaagcgtttttgcgtcagttccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgcactgattgtgttgcctccagctttttttgctctctatgagtgactacttaagtcacttgttgagagggattatttactaattatatacttctcattcctgtaactccattccctttaaacagtggtgatatcaaatatacttccatccattgaatggggtatttttaacaacaacaaaagtgatatactaaaaaatgtattgcttaaggcttattgaatcattttgaagcactttgtgtatttgaaaactgctttataatctcatttattaaaaggactttcaaagataaaaccaaaaaa

SEQ ID NO: 543 - DNA, 1009 bp, Homo sapiens
ctcgtgcggtgatgttgagcagaagatacaattcaaaagagaaacagccagtttgaaactgttaccccaccagccccgaattgtggagatgaagaaaggaagcaatggctatggtttctatctgagggcaggctcagaacagaaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgttccctccctggctgatgccagttgacagccctgcaggttctaaagaaggaatagtggtggagtcaaaccatgactcgcacatggcaaaagaacgggcggctattgcagacggctaatttatgcttaacttaggaagagataaggttccttgagcaccaaagatgattcataactctgtataggtgacagctgcttataaaagcatcttagcagataagcctattaaaattgtgcttttgtaaca

SEQ ID NO: 544 - DNA, 2834 bp, Homo sapiens
cactttgcgggcggcactttttccaggttgttaatccagctaatggagaaggatagatgcacgctacttggtttagaaaaaaaaacaaaaatgagcaaacgagacgccccttccgttttatgataactaagctgcagggaaataaatcggctggccctactgcaatctactgcactcgagaaacatcacagaaaattctttgatttatcttaatagtgacaagtgagcctgcttctgtcaattactgaagctataaggagattttttaaaaattaaacttcaacacaatgaggtgttgccacatctgcaaacttcctgggagagtaatggggattcgagtgcttcgattatctttggtggtcatcctcgtattattactggtagctggtgctttgactgccttacttcccagtgttaaagaagacaagatgctcatgttgcgtagggaaataaaatcccagggcaagtccaccatggactcctttactctcataatgcagacgtacaacagaacagatctcttattgaaacttttaaatcattatcaggctgtaccaaatctgcacaaagtgattgtggtatggaacaatattggagagaaggcaccagatgagttatggaattctctagggccccaccctatccctgtgatcttcaaacaacagacagcaaacaggatgagaaatcgactccaggtctttcctgaactggaaaccaatgcagtgttgatggtagatgatgacacactcatcagcaccccagaccttgtttttgctttctcagtttggcagcaatttcctgatcaaattgtaggatttgttcctagaaagcacgtctctacttcatcaggtatctacagttatggaagttttgaaatgcaagcaccagggtctggaaatggtgaccagtactctatggtgctgattggagcctcattcttcaatagcaaatatcttgaattatttcagaggcaacctgcagctgtccatgctttgatagatgatactcaaaactgtgatgatattgccatgaattttatcattgccaagcatattggcaagacttcagggatatttgtgaagcctgtaaacatggacaatttggaaaaagaaaccaacagtggctattctggaatgtggcatcgagctgagcacgctctgcagaggtcttattgtataaataagcttgttaatatctatgatagcatgcccttaagatactccaacattatgatttcccagtttggttttccatatgccaactacaaaagaaaaatataaaagtaaaacaaacaaaaacaaacctgaaaactgcttggcatttgagtagcttctccatgctatgtatttttttaagcaacatcatgaattttatctactccagaagtctctacaatagaaaaaaaagtgcagtgcttctaggatataaaattcacattacttttgaaagccaagaagttggtcttatccagttaggtcttcttatgaagagttttcatccagggatataactccttggtcagtgattttattgtttacatcctgagactgttctacagtttctttgactcctggcatttgccttaaggacctatagcaagctgtttctaggatcagaaactcaagagaggcatttctctgctttttcactaaaggtcagttgttttaatttgaaacctgaaatgcctctttagcaaaagcctgtggtatggggtaaagccatgtaagaagagaatagtctcagtcacatatgaagaggaaaatttgcagctgccagtgctttccttgtggccctgccaaccagctcttccaggacgaactcagtccagcatggttttgatgtaaccatccatgcttttatttttgttaagtcttttgtgactgggacagttaattttagtagctgaagaacgtctagttgtttgcttgatatttgtgaacatttactgcatggatcacaaaacaatataccctgtatttcttacacgccacttatatgcagcaaggagtaaatgtgttactagattcgggtagtgcattttgtcactgaatctgaccttgagaatgtacattaattcttatattttacataatgtatgtgttgtttaagaaatgtataaaaaacctgaaaaaaatgagtaagaactggcagaagttaaaaccctttgtatcaaaagatctttattggtagagcactggttatcttctggatactaaaaagttgtattacaaagccaaacacttgcattcacaactttaaaaaaagatccaaggaactattcataatgatgaaattccaactacatacaaggaggagaaaataagaacccagtcataacagaggaattctataggagtctgcatcaattcattcttaaggttgcctactctctgttatgtgaattagcgtctgtgtttcacccattgtctgtgtttagtccttgttcaccactaaggcaaggaattcttaactaggcctctgtttaccaacttctctttctcctcctttccctcttattcctccttctcctcttccttcttatataatgctagtatattctcaaaattgcaaagctgtgagaatattaaaataatcatggctaatgttccaataatgaggtctttgtgcatttagttccgcatatgatggttttttttttacattaaagagtatatgtgtcttaatgcagtcagattgtaaaaaacaaaaacaaagaaactaagaatcttactaaaaatcgataatgtcagttatctgttttgtccaatattggtagtacttttttgcctcttatgattcctctagcagataaataaaagaaacttttgccatcc

SEQ ID NO: 545 - DNA, 2319 bp, Homo sapiens
  modified_base (175): a, t, c, g, other or unknown
  modified_base (255): a, t, c, g, other or unknown
  modified_base (649): a, t, c, g, other or unknown
  modified_base (663): a, t, c, g, other or unknown
  modified_base (699): a, t, c, g, other or unknown
  modified_base (703): a, t, c, g, other or unknown
  modified_base (729): a, t, c, g, other or unknown
  modified_base (736): a, t, c, g, other or unknown
  modified_base (747): a, t, c, g, other or unknown
  modified_base (753): a, t, c, g, other or unknown
  modified_base (762): a, t, c, g, other or unknown
  modified_base (772): a, t, c, g, other or unknown
  modified_base (778): a, t, c, g, other or unknown
  modified_base (792): a, t, c, g, other or unknown
  modified_base (796)..(797): a, t, c, g, other or unknown
  modified_base (813): a, t, c, g, other or unknown
  modified_base (846): a, t, c, g, other or unknown
  modified_base (851)..(852): a, t, c, g, other or unknown
  modified_base (1068): a, t, c, g, other or unknown
  modified_base (1705): a, t, c, g, other or unknown
  modified_base (1105): a, t, c, g, other or unknown
  modified_base (1114): a, t, c, g, other or unknown
  modified_base (1119): a, t, c, g, other or unknown
  modified_base (1245): a, t, c, g, other or unknown
  modified_base (1264): a, t, c, g, other or unknown
  modified_base (1314): a, t, c, g, other or unknown
  modified_base (1332): a, t, c, g, other or unknown
  modified_base (1341)..(1342): a, t, c, g, other or unknown
  modified_base (1349): a, t, c, g, other or unknown
  modified_base (1358)..(1359): a, t, c, g, other or unknown
  modified_base (1370): a, t, c, g, other or unknown
  modified_base (1373): a, t, c, g, other or unknown
  modified_base (1394): a, t, c, g, other or unknown
  modified_base (1409): a, t, c, g, other or unknown
  modified_base (1464): a, t, c, g, other or unknown
  modified_base (1477): a, t, c, g, other or unknown
  modified_base (1489): a, t, c, g, other or unknown
  modified_base (1508): a, t, c, g, other or unknown
  modified_base (1516)..(1517): a, t, c, g, other or unknown
  modified_base (1521): a, t, c, g, other or unknown
  modified_base (1525): a, t, c, g, other or unknown
  modified_base (1530): a, t, c, g, other or unknown
  modified_base (1547)..(1548): a, t, c, g, other or unknown
  modified_base (1554): a, t, c, g, other or unknown
  modified_base (1558): a, t, c, g, other or unknown
  modified_base (1570): a, t, c, g, other or unknown
  modified_base (1574): a, t, c, g, other or unknown
  modified_base (1593): a, t, c, g, other or unknown
  modified_base (1599): a, t, c, g, other or unknown
  modified_base (1615): a, t, c, g, other or unknown
  modified_base (1745): a, t, c, g, other or unknown
  modified_base (1756): a, t, c, g, other or unknown
  modified_base (1782): a, t, c, g, other or unknown
  modified_base (1788): a, t, c, g, other or unknown
  modified_base (1808): a, t, c, g, other or unknown
  modified_base (1858): a, t, c, g, other or unknown
  modified_base (1876): a, t, c, g, other or unknown
  modified_base (1896): a, t, c, g, other or unknown
  modified_base (1899): a, t, c, g, other or unknown
  modified_base (1908): a, t, c, g, other or unknown
  modified_base (1916): a, t, c, g, other or unknown
  modified_base (1918): a, t, c, g, other or unknown
  modified_base (1922): a, t, c, g, other or unknown
  modified_base (1934): a, t, c, g, other or unknown
  modified_base (1941): a, t, c, g, other or unknown
  modified_base (1947): a, t, c, g, other or unknown
  modified_base (1950): a, t, c, g, other or unknown
  modified_base (1955): a, t, c, g, other or unknown
  modified_base (1964): a, t, c, g, other or unknown
  modified_base (1977): a, t, c, g, other or unknown
  modified_base (2008): a, t, c, g, other or unknown
  modified_base (2029): a, t, c, g, other or unknown
  modified_base (2034): a, t, c, g, other or unknown
  modified_base (2040): a, t, c, g, other or unknown
  modified_base (2050): a, t, c, g, other or unknown
  modified_base (2076): a, t, c, g, other or unknown
  modified_base (2087): a, t, c, g, other or unknown
  modified_base (2092): a, t, c, g, other or unknown
  modified_base (2149): a, t, c, g, other or unknown
  modified_base (2182): a, t, c, g, other or unknown
  modified_base (2192)..(2194): a, t, c, g, other or unknown
  modified_base (2293)..(2297): a, t, c, g, other or unknown
  modified_base (2308): a, t, c, g, other or unknown
aacgtcattggtaacagcaagtcccagacaccagcccccagttccgaagtggttttggattcaaagagacaagttgagagagaggaaaccaaccatgagatccaggaggggaaagaagagcctcagagggacaggctgccgcaggagccaggccgggagcaggtngtggaagacagacctgtaggtggaagaggcttcgggggagccggagaactgggccagaccccacaggtgcaggctgccctgtcagtgagnccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatgtttttaatgttgaagatcagaaaagagacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacatctgaangatgattattgtgnaaattttagtatgcactttgtgtaggaaaaaatggnaatnggtcttttaaacagcttttggggggntactttnggaagtgtctnaataanggtgtcacnaatttttggntagtanggtatttcgtgagnaagnnttcaacaccaaaactnggaacatagttctccttcaagtgttggcgacancgggnngcttcctgattctggaatataactttgtgtaaattaacagccacctatagaagagtccatctgctgtgaaggagagacagagaactctgggttccgtcgtcctgtccacgtgctgtaccaagtgctggtgccagcctgttacctgttctcactgaaaagtctggctaatgctcttgtgtagtcacttctgattctgacaatcaatcaatcaatggncctagangcactgactgttaacacaaacgtcactagncaaagtagncaacnagctttaagtctaaatacaaagctgttctgtgtgagaattttttaaaaggctacttgtataataacccttgtcatttttaatgtacaaaacgctattaagtggcttagaatttgaacatttgtggntctttatttactttgcttncgtgtgtgggcaaagcaacatcttccctaaatatatattaccaagaaaangcaagaagcagattaggntttttgacnnaaaacanaacaggccnnaaaagggggcntgnacctggagcagagcatggtgnagaggcaaggcatgnagagggcaagtttgttgtggacagatctgtgcctactttattactggagtaaaangaaaacaaagttncattgatgtcgnaaggatatatacagtgttnagaaattnnaggnactngtttnagaaaaacaggaatacnnaatggnttgntttttatcatangtgntacacatttagcttgtggntaaatngactcacaaaactganttttaaaatcaagttaatgtgaattttgaaaattactacttaatcctaattcacaataacaatggcattaaggtttgacttgagttggttcttagtattatttatggtaaataggctcttaccacttgcnaaataactggnccacatcattaatgactgacttcccnagtaanggctctctaaggggtaagtnaggaggatccacaggatttgagatgctaaggccccagagatcgtttgatnccaaccctcttattttcnagaggggaaaatggggcctnagnaagttacangagcatcntnagcntggtgcgctggncaccccntggccntcnacacnagactcccngagtagctggganctacaggcacacagtcactgaagcaggcccntgtttgcaattcacgttgccnacctnccaacnttaaacattncttcatatgtgatgtccttagtcacntaaggttaaanctttncccacccagaaaaggcaacttagataaaatcttagagtactttcatactcttctaangtcctcttccagcctcactttgagtcctccttnggggttgatnnnaggaattttctcttgctttctcaataaagtctctattcatctcatgtttaatttgtacgcatagaattgctgagaaataaaatgttctgttcaacttannnnnaaaaaaaaaanaaaaaaaaaaa

SEQ ID NO: 546 - DNA, 2456 bp, Homo sapiens
tgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagctccaaccaagagtgtgctccagatgtgttggggccctaacttggcacagagtcctgctcctgggaaaggaaaggaccacagcaaacaccattctttttgccgtacttcctagaagcactggaagaggactggtgatggtgggagggtgagagggtgccgttttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacattcaggggcaaccctgggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggacttcatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaatgtggtctggtcttgtggttttgttctgtcgtgactgtcactcagggtaacaacgtcatctctttctacatcaagagaagtaaattatttatgttatcagaggctaggctccgattcatgaaaggatagggtagagtagagggcttggcaataagaactggtttgtaagcccctaaaagtgtggcttagtgagatcagggaaggagaaagcatgactggattcttactgtgcttcagtcattattattatactgttcacttcacacattatcatacttcagtgactcagaccttgggcaaatactctgtgcctcgctttttcagtccataaaatgggcctacttaatagttgttgcaggacttacatgagataatagagtgtagaaaatatgttccaaagtggaaagttttattcagtgatagaaaacatccaaacctgtcacagagcccatctgaacacagcatgggaccgccaacaagaagaaagcccgcccggaagcagctcaatcaggaggctgggctggaatgacagcgcagcggggcctgaaactatttatatcccaaagctcctctcagataaacacaaatgactgcgttctgcctgcactcgggctattgcgaggacagagagctggtgctccattggcgtgaagtctccagggccagaaggggcctttgtcgcttcctcacaaggcacaagttccccttctgcttccccgagaaaggtttggtaggggtggtggtttagtgcctatagaacaaggcatttcgcttcctagacggtgaaatgaaagggaaaaaaaggacacctaatctcctacaaatggtctttagtaaaggaacc

SEQ ID NO: 547 - DNA, 2218 bp, Homo sapiens
gaggaaaaagaacaatgaacagcaacgatcttgactgtgcaactcagacattcctgcagaaaagacatatgttgctttacaagaaggccaaagaactatggggccttcccagcatttgactgttcattgcatagaatgaattaaatatccagttacttgaatgggtataacgcatgaatgtgtgattttattaggggcatctgccaattctctcactgtggttccttctctgactttgcctgttcatcatctaaggaggctagatccttcgctgacttcaccattcctcaaacctgtaagtttctcacttcttccaaattggctttggctctttcttcaacctttccattcaagagcaatctttgctaaggagtaagtgaatgtgaagagtaccaactacaacaattctacagataattagtggattgtgttgtttgttgagagtgaaggtttcttggcatctggtgcctgattaaggcttgagtattaagttctcagcatatctctctattgtcttgacttgagtttgctgcattttctatgtgctgttcgtgacttggagaacttaaagtaatcgagctatgccaacttggggtggtaacagagtacttcccaccacagtgttgaaagggagagcaaagtcttatggataaaccctcctttcttttggggacacatggctctcacttgagaagctcacctgtgctgaatgtccacatggtcactaaacatgttatccttaaaccccccgtatgcctgagttgaaagggctctctcttattaggttttcatgggaacatgaggcagcaaatctattgctaagactttaccaggctcaaatcatctgaggctgatagatatttgacttggtaagacttaagtaaggctctggctcccaggggcataagcaacagtttcttgaatgtgccatctgagaagggagacccaggttatgagttttcctttgaacacattggtcttttctcaaagttcctgccttgctagactgttagctctttgaggacagggactatgtcttatcaatcactattattttcctgttacctagcatgggacaagtacacaacacatatttgtgtagtcttctaaaagactcctctgattgggagaccatatctataattgggatgtgaatcatttcttcagtggaataagagcacaacggcacaaccttcaaggacatattatctactatgaacattttactgtgagactctttattttgccttctacttgcgctgaaatgaaaccaaaacaggccgttgggttccacaagtcaatatatgttggatgaggattctgttgccttattgggaactgtgagacttatctggtatgagaagccagtaataaacctttgacctgttttaaccaatgaagattatgaatatgttaatatgatgtaaattgctatttaagtgtaaagcagttctaagttttagtatttgggggattggtttttattatttttttcctttttgaaaaatactgagggatcttttgataaagttagtaatgcatgttagattttagttttgcaagcatgttgtttttcaaatatatcaagtatagaaaaaggtaaaacagttaagaaggaaggcaattatattattcttctgtagttaagcaaacacttgttgagtgcctgctatgtgcacggcatgggcccatatgtgtgaggagcttgtctaattatgtaggaagcaatagatctcggtagttacgtattgggcagatacttactgtatgaatgaaagaacatcacagtaatcacaatatcagagctgagttatccccagtgtagcttcgttggggattccagtttctgggaacgagagttagggccattttatttaaaagaaactcccggttgagaccggttcttatgaacctctgaaacgtacaagccttcacaagtttaactaaattgggattaatctttctgtagttatctgcataattcttgtttttctttccatctggctcctgggttgacaatttgtggaaacaactctattgctactatttaaaaaaaatcagaaatctttccctttaagctatgttaaattcaaactattcctgctattcctgttttgtcaaagaattatatttttcaaaatatgtttatttgtttgatgggtcccaggaaacactaataaaaaccacagagaccagccccaaaaaaaaaaaagttttg

SEQ ID NO: 548 - DNA, 2196 bp, Homo sapiens
cggcgcgatgcgcggagacccccgcgggggcggcggcggccgtgagccccgatgaggcccgagcgtccccggccgcgcggcagcgcccccggcccgatggagaccccgccgtgggacccagcccgcaacgactcgctgccgcccacgctgaccccggccgtgcccccctacgtgaagcttggcctcaccgtcgtctacaccgtgttctacgcgctgctcttcgtgttcatctacgtgcagctctggctggtgctgcgttaccgccacaagcggctcagctaccagagcgtcttcctctttctctgcctcttctgggcctccctgcggaccgtcctcttctccttctacttcaaagacttcgtggcggccaattcgctcagccccttcgtcttctggctgctctactgcttccctgtgtgcctgcagtttttcaccctcacgctgatgaacttgtacttcacgcaggtgattttcaaagccaagtcaaaatattctccagaattactcaaataccggttgcccctctacctggcctccctcttcatcagccttgttttcctgttggtgaatttaacctgtgctgtgctggtaaagacgggaaattgggagaggaaggttatcgtctctgtgcgagtggccattaatgacacgctcttcgtgctgtgtgccgtctctctctccatctgtctctacaaaatctctaagatgtccttagccaacatttacttggagtccaagggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggcagatttgaagaatcagctgggagatgctggatacgtattatttggagtggtgttatttgtttgggaactcttacctaccaccttagtcgtttatttcttccgagttagaaatcctacaaaggaccttaccaaccctggaatggtccccagccatggattcagtcccagatcttatttctttgacaaccctcgaagatatgacagtgatgatgaccttgcctggaacattgcccctcagggacttcagggaggttttgctccagattactatgattggggacaacaaactaacagcttcctggcacaagcaggaactttgcaaagactcaactttggatcctgacaaaccaagccttgggtagcatcagttaacagttttatggacgattcctcagatgaaaagcttcagaaaagcatagtgacagctgaatttttagggcacttttccttaagaaatagaacttgatttttatttgttacaggtttccaatggccccataggaataagcaataatgtagactgataaacccttattttagtactaaagagggagccttgctatttcagtgggtataatttaaactttttaaagaaaatctgtacttttataaagatgtattttgtataacttaaataataatgctaaagtatactagggtttttttttcttgagaatgttactgcaatcatgttgtagtttgcacagacttttatgcataattcactttaaaaatatagaatatatggtctaatagttttttaaagcttttggactaaagtattccacaaatcttacctctttaggtcactgatggtcactccgattctgagtgccacattggtagactcctaaaatacagttgacaacttagccaattgcaactccagtgttgataattaaaatgaaatggtaaagcagcagactgtaaggtctttagagattttttttttaaggttcaggccgtaggttcctcaaggaatctcttaagttttgcccaaagactggtacttcctttcagtagggcgctaatgtatacacattaatgataagttgataacattaaaaatgtagctgacttatcctattaaacctcctctgctatgttcacagaacccccataactttttttcagcctaatgaaatctaatatgcattacctcagggccacatcaagaatacacccctttccgaactcactgaatgttcattacattcaaggagaaaataagagggtccataaagggcattaataacaaataccccaagccgttgagctaagactatgtggaatcctaatagttttt

SEQ ID NO: 549 - DNA, 701 bp, Homo sapiens
aattaaaataaatagaaacatacggagattcttttatgttggatttattataccctccaccattttggtccctgaaaagggaaaagatacacggtcgagtagtacaggtatgtgtttcccactacacattatggctataatggagttgaattgcaaacagtaaaattttgttttggattggtttcccctgatccccccagacaggagcttcctctcccaccctacctgcctgcccttaagttgtgtcctattaaactggacacaaatctcaccggcttttagtctaataattgaatcatagctacacacagtgacaccagaatagctacttgtttttttatgttaccagtgagtaacttgtttatccttgtatgtagaaactaatttcaccatgatcacagatctgtgtaacatctctagtttgaatttccacacaattttaaaatgtctactagaaaacttacacctttttgttccaaggtgctcttcatctataaaaccgtgggcatacttcagtgttcttctgaggccaaattttgtgggtcgtgggggacaattttgtattaacatacgttattttgtaattcattctccaaatttgaagctttattaaaggtattctatttccactggcttcccttaacttgaataaaatttactcccagtgccgtggctcatgcctgctgcaatcccagcccttt

SEQ ID NO: 550 - DNA, 2214 bp, Homo sapiens
  modified_base (391): a, t, c, g, other or unknown
  modified_base (590): a, t, c, g, other or unknown
  modified_base (644): a, t, c, g, other or unknown
  modified_base (649): a, t, c, g, other or unknown
  modified_base (696): a, t, c, g, other or unknown
  modified_base (719): a, t, c, g, other or unknown
  modified_base (733): a, t, c, g, other or unknown
  modified_base (802): a, t, c, g, other or unknown
  modified_base (841): a, t, c, g, other or unknown
  modified_base (854): a, t, c, g, other or unknown
  modified_base (1767): a, t, c, g, other or unknown
  modified_base (1788): a, t, c, g, other or unknown
  modified_base (1809): a, t, c, g, other or unknown
  modified_base (1819): a, t, c, g, other or unknown
  modified_base (1855): a, t, c, g, other or unknown
gctaaagaggaggatgctatacttttctaaatggcaagagatggggagagaaggggattaagagttgacccgcaacctcccggtggattctttgttcttaccagatctcttggccactcccctattctgaagtcgtcttggctctcttgactgctcccctattctgaagtcgtcttggctctcttgactactcccctattctgaagtcgtcttggctctcctgactacactatttcaaggaatgatcaccaagacacacaaagtagaccttgggctcccagagaagaaaaagaagaagaaagtggtcaaagaaccagagactcgatactcagttttaaacaatgatgattactttgctgatgtttctcctttaagagctacatccccctcntaagagtgtggcccatgggcaggcacctgagatgcctctagtgaagaaaaagaagaagaaaaagaagggtgtcagcaccctttgcgaggagcatgtagaacctgagaccacgctgcctgctagacggacagagaagtcacccagcctcaggaagcaggtgtttggccacttggagttcctcagtggggaaaagaaaaantaagaagtcacctctagccatgtcccatgcctctggggtgaaaacctccccagnacccntagacagggtgaggaggaaaccagagttggcaagaagctcaaaaaancacaagaaggaaaaaaagggggncccaggaccccacnagccttctcggtccaggacccttggttctgtgaggccagggaggccagggatgttggggacacttgctncagtggggaagaaggatgaggaacaggcagccttggggncagaaacggaagncggaagagccccagagaacacaatgggaaggtgaagaagaaaaaaaaaatccaccaggagggagatgccctcccaggccactccaagccctccaggtccatggagagcagccctaggaaaggaagtaaaaagaagccagtcaaagttgaggctccggaatacatccccataagtgatgaccctaagtcctccgcaaagaaaaagatgaagtccaaaaagaaggtagagcagccagtcatcgaggagccagctctgaaaaggaagacgaggaagaagaggaaagagagtggggtagcaggagacccttggagggaggaaacagacacggacttagaggtggtgttggaaaaaaaaggcaacatggatgaggcgcacatagaccaggtgaggcgaaaggccttgcaagaagagatcgatcgcgagtcaggcaaaacggaagcttctgaaaccaggaagtggacgggaacccagtttggccagtgggatactgctggttttgagaacgaggaccaaaaactgaaatttctcagacttatgggtggcttcaaaaacctgtccccttcgttcagccgccccgccagcacgattgcaaggcccaacatggccctcggcaagaaggcggctgacagcctgcagcagaatctgcagcgggactacgaccgggccatgagcttggaagtacagccggggagccggcttgcggtgttctccaccgcccccaacaagatcttttacattgacaggaacgcttccaagtcagtcaagctggaagattaaactctagagttttgtccccccaaaactgccacaattgctttgattattccatttatgctggagattacaaattttttttggtgaacaaatcagatcttggtgaggacctcgagcagtaagatataaataactcccnataagcttagncgttcccagtaatggaacactaggcataaantggtttattncagttgtgcaaatgaaagccatctgacagttggctncacattgaacacctgtggagattaaggacgaggacaactatattgatgggcttggatgaactggggcagggcagctcatatttcgggagccaggagaacgagtgagtgctaaaacctcctgttttctgtgttaaacattccgtccctgtttgagacatcagtatgtacagttaacttttgttgagtgtttagcaggtactagggacatactagtgttttccttaatgtatttaatcttcataattatgaaatgggtgctattattagccccatcttatagatgaggcaactgaggttcagggataaagtaataaaattgcctggggtcacccagccactaaaaaaaaaaaaaaaaaaaa

SEQ ID NO: 551 - DNA, 1434 bp, Homo sapiens; identical to SEQ ID NO: 113

SEQ ID NO: 552 - DNA, 2434 bp, Homo sapiens
  modified_base (753): a, t, c, g, other or unknown
  modified_base (853): a, t, c, g, other or unknown
  modified_base (1031): a, t, c, g, other or unknown
  modified_base (1094): a, t, c, g, other or unknown
  modified_base (1103)..(1104): a, t, c, g, other or unknown
  modified_base (1144)..(1145): a, t, c, g, other or unknown
  modified_base (1506): a, t, c, g, other or unknown
  modified_base (1509): a, t, c, g, other or unknown
  modified_base (1545): a, t, c, g, other or unknown
  modified_base (1568): a, t, c, g, other or unknown
  modified_base (1607): a, t, c, g, other or unknown
  modified_base (1611): a, t, c, g, other or unknown
  modified_base (1618)..(1619): a, t, c, g, other or unknown
  modified_base (1628): a, t, c, g, other or unknown
  modified_base (1631): a, t, c, g, other or unknown
  modified_base (1636): a, t, c, g, other or unknown
  modified_base (1643): a, t, c, g, other or unknown
  modified_base (1647): a, t, c, g, other or unknown
  modified_base (1804): a, t, c, g, other or unknown
  modified_base (1830): a, t, c, g, other or unknown
  modified_base (1857): a, t, c, g, other or unknown
  modified_base (1904): a, t, c, g, other or unknown
  modified_base (1926): a, t, c, g, other or unknown
  modified_base (1955): a, t, c, g, other or unknown
  modified_base (1970): a, t, c, g, other or unknown
  modified_base (1982): a, t, c, g, other or unknown
  modified_base (2003): a, t, c, g, other or unknown
  modified_base (2014)..(2015): a, t, c, g, other or unknown
  modified_base (2033): a, t, c, g, other or unknown
  modified_base (2043): a, t, c, g, other or unknown
  modified_base (2051): a, t, c, g, other or unknown
  modified_base (2064)..(2065): a, t, c, g, other or unknown
  modified_base (2072): a, t, c, g, other or unknown
  modified_base (2111): a, t, c, g, other or unknown
  modified_base (2117): a, t, c, g, other or unknown
  modified_base (2124): a, t, c, g, other or unknown
  modified_base (2144): a, t, c, g, other or unknown
  modified_base (2149): a, t, c, g, other or unknown
  modified_base (2159): a, t, c, g, other or unknown
  modified_base (2170): a, t, c, g, other or unknown
  modified_base (2190): a, t, c, g, other or unknown
  modified_base (2208): a, t, c, g, other or unknown
  modified_base (2215): a, t, c, g, other or unknown
  modified_base (2221): a, t, c, g, other or unknown
  modified_base (2230): a, t, c, g, other or unknown
  modified_base (2233): a, t, c, g, other or unknown
  modified_base (2241): a, t, c, g, other or unknown
  modified_base (2283): a, t, c, g, other or unknown
  modified_base (2371): a, t, c, g, other or unknown
cccggagaaggtggagggagacgagaagccgccgagagccgactaccctccgggcccagtctgtctgtccgtggtggatctaagcctcatctgtatcctcttgtgatggcgtgaaggaaagccatggcagatttccagcctggtgatgctgtacagaacacaggtggcctgcttccatgcctcctcagcttcaagaaactagaatgaaccgaagcattcctgtggaggttgatgaatcagaaccatacccaagtcagttgctgaaaccaatcccagaatattccccggaagaggaatcagaaccacctgctccaaatataaggaacatggcacccaacagcttgtctgcacccacaatgcttcacaattcctccggagacttttctcaagctcactcaaccctgaaacttgcaaatcaccagcggcctgtatcccggcaggtcacctgcctgcgcactcaagttctggaggacagtgaagacagtttctgcaggagacacccaggcctgggcaaagctttcccttctgggtgctctgcagtcagcgagcctgcgtctgagtctgtggttggagccctccctgcagagcatcagttttcatttatggaaaaacgtaatcaatggctggtatctcagctttcagcggcttctcctgacactggccatgactcagacaaatcagaccaaagtttacctaatgcctcagcagactccttgggcggtagccaggagatggtgcaacggccccagcctncacaggaaccgagcaggcctggatctgccaaccatagacacgggatatgattcccagccccaggatgtcctgggcatcaggcagctggaaaggcccctgnccctcacctccgtgtgttacccccaggacctccccagacctctcaggtccagggagttccctcagtttgaacctcagaggtatccagcatgtgcacagatgctgcctcccaatctttccccacatgctccatggaactatcattaccattgtcctggaagtcccgatcaccaggtgcncatatggccatgactaccctcgagcagcctaccagcaagtgatccagccggctctgcctgggncagcccctnngcctggagccagtgtgagaggcctgcaccctgtgcagaannggttatcctgaattatcccagcccctgggaccaagaagagaggcccgcacagagagactgctcctttccggggcttccaaggcaccaggaccagccacatcaccagccacctaatagagctggtgctcctggggagtccttggagtgccctgcagagctgagaccacaggttccccagcctccgtccccagctgctgtgcctagaccccctagcaaccctccagccagaggaactctaaaaacaagcaatttgccagaagaattgcggaaagtctttatcacttattcgatggacacagctatggaggtggtgaaattcgtgaactttttgttggtaaatggcttccaaactgcaattgancantatttgaggatagaatccgaggcattgatatcattnaaatggatggagcgctaccttangggataagaccgtgatgataatcgtagcaatcagccccnaaantacaaanncaggacgtnggnaaggncgctgangtcngcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacacntcatgtctacagctggcccaagaatnaaaaaaaacatcctgctgcggctgctngagagaggaagagtatgtggctcctccacgggggcctctgcccaccncttcaggtggttcccttgtgancaccgttcatccccagatcactgaggccnaggccatgtttgggngccttgttctgnacagcattctggctgaggctnggtcggtagcannctcctggctggtttttnttctgttccntccccgangaagccctctggnncccccanggaaacctgttgtgcagagctcttccccggagacctccnacacanccctggnctttgaagtggagtctgtgnactgnctctgcattnctctgcttttnaaaaaaaccattgcaggtgnccagtgtcccatatgttncctcctngacagntttgatgtngtnccattctngggcctctcagtgcttagcaagtagataatgtaagggatgtnggcagcaaatggaaatgactacaaacactctcctatcaatcacttcaggctacttttatgagttagccagatgcttgtgtatcctcangaccaaactgattcatgtacaaataataaaatgtttactcttttgtaaaaaaaaaaaaaaaaa

SEQ ID NO: 553 - skipped

SEQ ID NO: 554 - DNA, 1457 bp, Homo sapiens
actaacccagagttgtggcattattaattatcactggtcttcttaatcgtaaaacgggggaccccagaggcaaggaaatttccattaccctatattgggcttaaacttaaaggagtatatccactatcaagagcttagtacaaaggctggggtgaagttacattatacctgggcgttttaccataccagggaccccacctcaacaatgactgtggaagaccaaaggagatacctaggttcagattataataaatcacccagcaccacctgaatgtattatccacaaagatatagcaataataaaggttatatatacatatatttatcttggtaacctgagggctaaaaacgtggaatacgataattcttctcaagaggtccatctgtaagaaagggacccaaaaggacagtgtttgtgttgcataaaatatgggtaaagtggagttgggaacaaagggtggtttctttagctctttccacatctctctttgataaggactgaaaccctgttgattcatgataaacgtttcctttttttttttttttggcagcggggagagggaaagaggaggaaatggggtttgaggaccatggcttacctttcctgcctttgacccatcacaccccatttcctcctctttccctctccccgctgccaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaagtttttttttggttggtttggtttaaaatcaagcctgaggctgggtggaaacaggtagcctacacaccccaaattgggggtggtcccgggggaatgtt

SEQ ID NO: 555 - DNA, 741 bp, Homo sapiens
  modified_base (381): a, t, c, g, other or unknown
  modified_base (398): a, t, c, g, other or unknown
cctcctaaaagactgggaaagcagctttgggctttgggtcctcctaaaaaaaccaaggcggatgacttggggtttggatccccttcggatgtcactcgaaaaagccttagcagacctgattgagaaggaactgtcccgttcaaagaccaaccttccctttcgccccacatctcttcagaactcctcttcacacactacaaccgccaaaggtcccaggctctggattcctgcatcctgctgcagctacaaatgccaattctctaaatagtaccttttcagtcttgccccagaggttccctcaatttcagcagcaccgagcggtttataattcattcagttttccaggccaggcagcccgctatccttggatggcctttccancgcaatagcatcatgcnacttgaaccacacagcaaaccccacctcaaatagtaatttcttggacttgaatctcccgccacagcacaacacaggtctgggagggatccctgtagcaggggaagaagaggtgaaggtttcgaccatgccactgtcaacctcttcccattcattacaacaaggacagcagcctacaagtctccacactactgtggcctgacaacagaactgagaggagaggattagactctggggtgcttgcatgggcaactggatttttgcatgattcctttatgattttgcttttaatgtatacacccagaagagccaatataaacgttcctcatgcctaaaaaaaaaaaa

SEQ ID NO: 556-560 - skipped (5 entries)

SEQ ID NO: 561 - protein, 470 aa, Homo sapiens
TDQPNIQSVKIHSLPLRNPNKGCECPPRRDGFGFIKCVDRDVRMFFHFSEILDGNQLHIADEVEFTVVPDMLSAQRNHAIRIKKLPKGTVSFHSHSDHRFLGTVEKEATFSNPKTTSPNKGKEKEAEDGIIAYDDCGVKLTIAFQAKDVEGSTSPQIGDKVEFSISDKQRPGQQVATCVRLLGRNSNSKRLLGYVATLKDNFGFIETANHDKEIFFHYSEFSGDVDSLELGDMVEYSLSKGKGNKVSAEKVNKTHSVNGITEEADPTIYSGKVIRPLRSVDPTQTEYQGMIEIVEEGDMKGEVYPFGIVGMANKGDCLQKGESVKFQLCVLGQNAQTMAYNITPLRRATVECVKDQFGFINYEVGDSKKLFFHVKEVQDGIELQAGDEVEFSVILNQRTGKCSACNVWRVCEGPKAVAAPRPDRLVNRLKNITLDDASAPRLMVLRQPRGPDNSMGFGAERKIRQAGVID

SEQ ID NO: 562 - protein, 126 aa, Homo sapiens; identical to SEQ ID NO: 198

SEQ ID NO: 563 - protein, 85 aa, Homo sapiens; identical to SEQ ID NO: 199

SEQ ID NO: 564 - protein, 549 aa, Homo sapiens; identical to SEQ ID NO: 208

SEQ ID NO: 565 - protein, 132 aa, Homo sapiens [sequence omitted]

SEQ ID NO: 566 - protein, 90 aa, Homo sapiens; identical to SEQ ID NO: 209

SEQ ID NO: 567 - protein, 331 aa, Homo sapiens
SANHKLEVNGTDGLAPVEVEELLRQASERNSKSPTEYHEPVYANPFYRPTTPQRETVTPGPNFQERIKIKTNGLGIGVNESIHNMGNGLSEERGNNFNHISPIPPVPHPRSVIQQAEEKLHTPQKRLMTPWEESNVMQDKDAPSPKPRLSPRETIFGKSEHQNSSPTCQEDEEDVRYNIVHSLPPDINDTEPVTMIFMGYQQAEDSEEDKKFLTGYDGIIHAELVVIDDEEEEDEGEAEKPSYHPIAPHSQVYQPAKPTPLPRKRSEASPHENTNHKSPHKNSISLKEQEESLGSPVHHSPFDAQTTGDGTEDPSLTALRMRMAKLGKKVI

SEQ ID NO: 568 - protein, 216 aa, Homo sapiens
LSLTSRMEEAELVKGRLQAITDKRKIQEEISQKRLKIEEDKLKHQHLKKKALREKWLLDGISSGKEQEEMKKQNQQDQHQIQVLEQSILRLEKEIQDLEKAELQISTKEEAILKKLKSIERTTEDIIRSVKVEREERAEESIEDIYANIPDLPKSYIPSRLRKEINEEKEDDEQNRKALYAMEIKVEKDLKTGESTVLSSNTSGHQMTLKGTGVKV

SEQ ID NO: 569 - protein, 132 aa, Homo sapiens
LEKLHICFPQLFGNFSQIMTTTYSHGLIWYTVMIIFWTSEKINKISRREICKCFLVSSSKDVYIGGTTLRSPFFPALPFSSLKLLRMDPQSHLQLSEHQMGNGGQGCLSFLLALSEIWNFCGGIYDLCFHED

SEQ ID NO: 570 - protein, 199 aa, Homo sapiens
NFVTPWSFWWWTKLTFFFPLALKKSSRVSSSHLPRIYQAFLMSATFNEDVQALKELILHNPVTLKLQESQLPGPDQLQQFQVVCETEEDKFLLLYALLKLSLIRGKSLLFVNTLERSYRLRLFLEQFSIPTCVLNGELPLRSRCHIISQFNQGFYDCVIATDAEVLGAPRQRAMRPRRRAKTGTMASRFLERTVVALGH

SEQ ID NO: 571 - protein, 195 aa, Homo sapiens
QRVRAALLSSAMEDSEALGFEHMGLDPRLLQAVTDLGWSRPTLIQEKAIPLALEGKDLLARARTGSGKTAAYAIPMLQLLLHRKATGPVVEQAVRGLVLVPTKELARQAQSMIQQLATYCARDVRVANVSAAEDSVSQRAVLMEKPDVVVGTPSRILSHLQQDSLKLRDSLELLVVDEADLLFSFGFEEELKSLL

SEQ ID NO: 572 - protein, 76 aa, Homo sapiens; identical to SEQ ID NO: 236

SEQ ID NO: 573 - protein, 91 aa, Homo sapiens
  MOD_RES (64): Any, other, or unknown amino acid
DSQVGRGPQRNSSLHTGRSVHWGEATGSLRHLQWGRAQPLLFLGGKLRFKLPGGKSMGRKQALXLLRVSVSPFFPLCLINKFHFSHPSNSL

SEQ ID NO: 574 - protein, 89 aa, Homo sapiens
  MOD_RES (22): Any, other, or unknown amino acid
EKWNLLIRHKGKKGETETLSKXRACFLPMDFPPGSLNRSFPPRKRRGWALPHWRWRKLPVASPQCTLLPVCRLEFLWGPLPTWLSHCPL

SEQ ID NO: 575 - protein, 80 aa, Homo sapiens [sequence omitted]

SEQ ID NO: 576 - skipped

SEQ ID NO: 577 - protein, 161 aa, Homo sapiens
  MOD_RES (15): Any, other, or unknown amino acid
  MOD_RES (20)..(21): Any, other, or unknown amino acid
  MOD_RES (35): Any, other, or unknown amino acid
  MOD_RES (39): Any, other, or unknown amino acid
  MOD_RES (45): Any, other, or unknown amino acid
  MOD_RES (80): Any, other, or unknown amino acid
  MOD_RES (85): Any, other, or unknown amino acid
  MOD_RES (87): Any, other, or unknown amino acid
LLPLLLLLIHGDTPXGPGPXXQEQAPNHRHGLEEXRISXKSCMGXVDWNGPEGVEIYVDGKEPHNKSQSSQLGFKTNGHXKSSEXVXHDVLDNRKEAGVKVKEGHEHQNQQDPASELHVLFGGALTHGGDARKHALPFRTGFSRSTQQPPPRARFLPLCRT

SEQ ID NO: 578 - protein, 160 aa, Homo sapiens
  MOD_RES (11): Any, other, or unknown amino acid
  MOD_RES (14): Any, other, or unknown amino acid
  MOD_RES (33): Any, other, or unknown amino acid
  MOD_RES (41): Any, other, or unknown amino acid
  MOD_RES (45): Any, other, or unknown amino acid
  MOD_RES (47): Any, other, or unknown amino acid
  MOD_RES (56): Any, other, or unknown amino acid
  MOD_RES (61)..(62): Any, other, or unknown amino acid
  MOD_RES (64): Any, other, or unknown amino acid
  MOD_RES (69): Any, other, or unknown amino acid
  MOD_RES (94): Any, other, or unknown amino acid
  MOD_RES (100): Any, other, or unknown amino acid
  MOD_RES (104): Any, other, or unknown amino acid
  MOD_RES (108): Any, other, or unknown amino acid
  MOD_RES (120)..(121): Any, other, or unknown amino acid
  MOD_RES (150)..(151): Any, other, or unknown amino acid
  MOD_RES (155): Any, other, or unknown amino acid
QTDNLSERQPXGKXVCRGCPQGECSWERAVLLXPGRPALSXTLLXKXAPCEVNWVXVRGSXXCXGAPAXTPXPXQRXAASAXAGLEXSXAXAGXAGCCCXGLPXVWSXLALPTASLEASXXPRPAASPRTSCPSTLPQATKTPRVLPNKXXLGTXSKLIF

SEQ ID NO: 579 - protein, 437 aa, Homo sapiens
SQGVLSSDGVWRVKSIPNGKGSSPLPTATTPKPLIPTEASIRVWGTSGTSHLHPRSICMIQKYNHDGEAGRLEAFSQGESVLKEPKYQEELEDRLHFYVEECDYLQGFQILCDLHDGFSGVGAKAAELLQDEYSGRGIITWGLLPGPYHRGEAQRNIYRLLNTAFGLVHLTAHSSLVCPLSLGGSLGLRPEPPVSFPYLHYDATLPFHCSAILATALDTVTVPYRLCSSPVSMVHLADMLSFCGKKVVTAGAIIPFPLAPGQSLPDSLMQFGGATPWTPLSACGEPSGTRCFAQSVVLRGYRQSMPHKPQNQRDTSTLCPSCMYHWGRNLGSVFTTAAAWSHEFFPSAADSLQGGSSLPPPLLKLQSTGYGSGWFPQGSRSSVSLSLPQQWRASQCLGHCVPLRPCTRPWKPWPETSPNSTCGAGPASWMLEWSTMT

SEQ ID NO: 580 - protein, 277 aa, Homo sapiens
TERLLLDGPPPHSPETPQFPPTTGAVLYTVKRNQVGPEVRSCPKASPRLQKEREGQKAVSESEALMLVWDASETEKLPGTVEPPASFLSPVSSKTRDAGRRHVSGKPDTQERWLPSSRARVKTRDRTCPVHESPSGIDTSETSPKAPRGGLAKDSGTQAKGPEGEQQPKAAEATVCANNSKVSSTGEKVVLWTREADRVILTMCQEQGAQPQTFNIISQQLGNKTPAEVSHRFRELMQLFHTACEASSEDEDDATSTSNADQLSDHGDLLSEEELDE

SEQ ID NO: 581 - protein, 172 aa, Homo sapiens [sequence omitted]

SEQ ID NO: 582 - protein, 549 aa, Homo sapiens
EFPPGLTEPTAVRALARARRTRAGSASDPERSPGAMALSELALVRWLQESRRSRKLILFIVFLALLLDNMLLTVVVPIIPSYLYSIKHEKNATEIQTARPVHTASISDSFQSIFSYYDNSTMVTGNATRDLTLHQTATQHMVTNASAVPSDCPSEDKDLLNENVQVGLLFASKATVQLITNPFIGLLTNRIGYPIPIFAGFCIMFVSTIMFAFSSSYAFLLIARSLQGIGSSCSSVAGMGMLASVYTDDEERGNVMGIALGGLAMGVLVGPPFGSVLYEFVGKTAPFLVLAALVLLDGAIQLFVLQPSRVQPESQKGTPLTTLLKDPYILIAAGSISFANMGIAMLEPALPIWMMETMCSRKWQLGVAFLPASISYLIGTNIFGILAHKMGRWLCALLGMIIVGVSILCIPFPKNIYGLIAPNFGVGFANGMVDSSMMPIMGYLVDLRHVSVYGSVYAIADVAFCMGYAIGPSAGGAIAKAIGFPWLMTIIGIIDILFAPLCFFLRSPPAKEEKMAILMDHNCPIKTKMYTQNNIQSYPIGEDEESESD

SEQ ID NO: 583 - protein, 121 aa, Homo sapiens
YLLSHWNQYFWDTCTQNGEVALCSSGNDNCWSQHFMYSISKKHLWTHSSELWSWFCKWNGGFVNDAYHGLPRRPAARVRLWECVRHCGCGILYGVCYRSFCWWCYCKGNWISMAHDNYWDN

SEQ ID NO: 584 - protein, 106 aa, Homo sapiens [sequence omitted]

SEQ ID NO: 585 - protein, 409 aa, Homo sapiens
KSRLSVTLMPVQLSEHPEWNESMHSLRISVGGLPVLASMTKAADPRFRPRWKVILTFFVGAAILWLLCSHRPAPGRPPTHNAHNWRLGQAPANWYNDTYPLSPPQRTPAGIRYRIAVIADLDTEPTAQDENTWRSDLKKGYLTLSDSGDKVAVEWDKDHGVLESHLAEKGRGMELSDLIVFNGKLYSVDDRTGVVYQIEGSKAVPWVILSDGDGTVEKGFKAEWLAVKDERLYVGGLGKEWTTTTGDVVNENPEWVKVVGYKGSVDHENWVSNYNALRAAAGIQPPANLIHESACWSDTLQRWFFLPRRASQERYSEKDDERKGANLLLSASPDFGDIAVSHVGAVVPTHGFSSFKFIPNTDDQIIVALKSEEDSGRVASYIMAFTLDGRFLLPETKIGSVKYEGIEFI

SEQ ID NO: 586 - protein, 249 aa, Homo sapiens [sequence omitted]

SEQ ID NO: 587 - protein, 157 aa, Homo sapiens [sequence omitted]

SEQ ID NO: 588 - protein, 144 aa, Homo sapiens; identical to SEQ ID NO: 306

SEQ ID NO: 589 - protein, 128 aa, Homo sapiens; identical to SEQ ID NO: 307

SEQ ID NO: 590 - protein, 61 aa, Homo sapiens; identical to SEQ ID NO: 305

SEQ ID NO: 591 - protein, 173 aa, Homo sapiens; identical to SEQ ID NO: 317

SEQ ID NO: 592 - protein, 105 aa, Homo sapiens; identical to SEQ ID NO: 319

SEQ ID NO: 593 - protein, 105 aa, Homo sapiens; identical to SEQ ID NO: 319

SEQ ID NO: 594 - protein, 172 aa, Homo sapiens
TPALRARSLRDRCARAPCPHGGQQRRRRRLNAEGAEGARGGGSSYSEMAETVADTRRLITKPQNLNDAYGPPSNFLEIDVSNPQTVGVGRGRFTTYEIRVKTNLPIFKLKESTVRRRYSDFEWLRSELERESKVVVPPLPGKAFLRQFLLEEMMEYLMTILLRKENKGWSSL

SEQ ID NO: 595 - protein, 127 aa, Homo sapiens [sequence omitted]

SEQ ID NO: 596 - protein, 123 aa, Homo sapiens [sequence omitted]

SEQ ID NO: 597 - protein, 262 aa, Homo sapiens
SCGDVEQKIQFKRETASLKLLPHQPRIVEMKKGSNGYGFYLRAGSEQKGQIIKDIDSGSPAEEAGLKNNDLVVAVNGESVETLDHDSVVEMIRKGGDQTSLLVVDKETDNMYRLAHFSPFLYYQSQELPNGSVKEAPAPTPTSLEVSSPPDTTEEVDHKPKLCRLAKGENGYGFHLNAIRGLPGSFIKEVQKGGPADLAGLEDEDVIIEVNGVNVLDEPYEKVVDRIQSSGKNVTLLVCGKKAYDYFQAKKIPIVPSLADAS

SEQ ID NO: 598 - protein, 65 aa, Homo sapiens; identical to SEQ ID NO: 337

SEQ ID NO: 599 - protein, 63 aa, Homo sapiens; identical to SEQ ID NO: 336

SEQ ID NO: 600 - protein, 336 aa, Homo sapiens
KLNFNTMRCCHICKLPGRVMGIRVLRLSLVVILVLLLVAGALTALLPSVKEDKMLMLRREIKSQGKSTMDSFTLIMQTYNRTDLLLKLLNHYQAVPNLHKVIVVWNNIGEKAPDELWNSLGPHPIPVIFKQQTANRMRNRLQVFPELETNAVLMVDDDTLISTPDLVFAFSVWQQFPDQIVGFVPRKHVSTSSGIYSYGSFEMQAPGSGNGDQYSMVLIGASFFNSKYLELFQRQPAAVHALIDDTQNCDDIAMNFIIAKHIGKTSGIFVKPVNMDNLEKETNSGYSGMWHRAEHALQRSYCINKLVNIYDSMPLRYSNIMISQFGFPYANYKRKI

SEQ ID NO: 601 - protein, 101 aa, Homo sapiens
HALKILQHYDFPVWFSICQLQKKNIKVKQTKTNLKTAWHLSSFSMLCIFLSNIMNFIYSRSLYNRKKSAVLLGYKIHITFESQEVGLIQLGLLMKSFHPGI

SEQ ID NO: 602 - protein, 90 aa, Homo sapiens
FKSFNKRSVLLYVCIMRVKESMVDLPWDFISLRNMSILSSLTLGSKAVKAPATSNNTRMTTKDNRSTRIPITLPGSLQMWQHLIVLKFNF

SEQ ID NO: 603 - protein, 163 aa, Homo sapiens
  MOD_RES (81): Any, other, or unknown amino acid
  MOD_RES (111): Any, other, or unknown amino acid
IYGVSFLIFNIKNIYVSVIPCQGCLLVCLRFCFIFIHVVVIFSSQFLLVSPFPGSFLLLLLSVGDDKLVSLRALHLWIFLXSLTGQPAPVGSGPVLRLPRSLFHLQVCLPXPAPGLAPAAACPSEALLSPPGSHGWFPLSQLVSLNPKPLRNWGLVSGTCCYQ

SEQ ID NO: 604 - protein, 150 aa, Homo sapiens
  MOD_RES (21): Any, other, or unknown amino acid
  MOD_RES (27): Any, other, or unknown amino acid
  MOD_RES (44): Any, other, or unknown amino acid
  MOD_RES (50): Any, other, or unknown amino acid
  MOD_RES (53): Any, other, or unknown amino acid
  MOD_RES (55): Any, other, or unknown amino acid
  MOD_RES (59): Any, other, or unknown amino acid
  MOD_RES (63): Any, other, or unknown amino acid
  MOD_RES (70): Any, other, or unknown amino acid
  MOD_RES (75): Any, other, or unknown amino acid
  MOD_RES (94): Any, other, or unknown amino acid
  MOD_RES (98): Any, other, or unknown amino acid
  MOD_RES (102): Any, other, or unknown amino acid
  MOD_RES (108): Any, other, or unknown amino acid
  MOD_RES (111): Any, other, or unknown amino acid
  MOD_RES (113)..(114): Any, other, or unknown amino acid
  MOD_RES (116): Any, other, or unknown amino acid
  MOD_RES (122): Any, other, or unknown amino acid
  MOD_RES (124)..(125): Any, other, or unknown amino acid
  MOD_RES (129)..(130): Any, other, or unknown amino acid
  MOD_RES (137): Any, other, or unknown amino acid
  MOD_RES (139): Any, other, or unknown amino acid
  MOD_RES (144): Any, other, or unknown amino acid
PLSFLMYKTLLSGLEFEHLWXFIYFAXVCGQSNIFPKYILPRKXKKQIRXFDXKXNRPXKGAXTWSRAWXRGKAXRGQVCCGQICAYFITGVKXKQSXIDVXRIYTVXRNXRXXFXKNRNTXWXXFYHXXYTFSLWXNXLTKLXFKIKLM

SEQ ID NO: 605 - protein, 108 aa, Homo sapiens
  MOD_RES (5): Any, other, or unknown amino acid
  MOD_RES (12): Any, other, or unknown amino acid
  MOD_RES (19)..(20): Any, other, or unknown amino acid
  MOD_RES (24)..(25): Any, other, or unknown amino acid
  MOD_RES (27)..(28): Any, other, or unknown amino acid
  MOD_RES (35): Any, other, or unknown amino acid
  MOD_RES (38): Any, other, or unknown amino acid
  MOD_RES (41): Any, other, or unknown amino acid
  MOD_RES (47): Any, other, or unknown amino acid
  MOD_RES (51): Any, other, or unknown amino acid
  MOD_RES (74): Any, other, or unknown amino acid
  MOD_RES (79): Any, other, or unknown amino acid
  MOD_RES (86)..(87): Any, other, or unknown amino acid
  MOD_RES (90)..(91): Any, other, or unknown amino acid
  MOD_RES (94): Any, other, or unknown amino acid
  MOD_RES (96): Any, other, or unknown amino acid
  MOD_RES (99): Any, other, or unknown amino acid
LDFKXQFCESIXPQAKCVXXMIKXXPXXIPVFLKXVPXISXHCIYPXDINXTLFSFYSSNKVGTDLSTTNLPSXCLASXPCSAPGXXPLXXPVXFXVKXPNLLLAFSW

SEQ ID NO: 606 - protein, 203 aa, Homo sapiens [sequence omitted]

SEQ ID NO: 607 - protein, 154 aa, Homo sapiens [sequence omitted]

SEQ ID NO: 608 - protein, 123 aa, Homo sapiens [sequence omitted]

SEQ ID NO: 609 - protein, 88 aa, Homo sapiens [sequence omitted]

SEQ ID NO: 610 - protein, 80 aa, Homo sapiens [sequence omitted]

SEQ ID NO: 611 - protein, 71 aa, Homo sapiens; identical to SEQ ID NO: 404

SEQ ID NO: 612 - protein, 395 aa, Homo sapiens
APMRPERPRPRGSAPGPMETPPWDPARNDSLPPTLTPAVPPYVKLGLTVVYTVFYALLFVFIYVQLWLVLRYRHKRLSYQSVFLFLCLFWASLRTVLFSFYFKDFVAANSLSPFVFWLLYCFPVCLQFFTLTLMNLYFTQVIFKAKSKYSPELLKYRLPLYLASLFISLVFLLVNLTCAVLVKTGNWERKVIVSVRVAINDTLFVLCAVSLSICLYKISKMSLANIYLESKGSSVCQVTAIGVTVILLYTSRACYNLFILSFSQNKSVHSFDYDWYNVSDQADLKNQLGDAGYVLFGVVLFVWELLPTTLVVYFFRVRNPTKDLTNPGMVPSHGFSPRSYFFDNPRRYDSDDDLAWNIAPQGLQGGFAPDYYDWGQQTNSFLAQAGTLQRLNFGS

SEQ ID NO: 613 - protein, 213 aa, Homo sapiens
ARCAETPAGAAAAVSPDEARASPAARQRPRPDGDPAVGPSPQRLAAAHADPGRAPLREAWPHRRLHRVLRAALRVHLRAALAGAALPPQAAQLPERLPLSLPLLGLPADRPLLLLLQRLRGGQFAQPLRLLAALLLPCVPAVFHPHADELVLHAGDFQSQVKIFSRITQIPVAPLPGLPLHQPCFPVGEFNLCCAGKDGKLGEEGYRLCASGH

SEQ ID NO: 614 - protein, 161 aa, Homo sapiens [sequence omitted]

SEQ ID NO: 615 - protein, 102 aa, Homo sapiens; identical to SEQ ID NO: 425

SEQ ID NO: 616 - protein, 86 aa, Homo sapiens [sequence omitted]

SEQ ID NO: 617 - protein, 76 aa, Homo sapiens [sequence omitted]

SEQ ID NO: 618 - protein, 378 aa, Homo sapiens
  MOD_RES (223): Any, other, or unknown amino acid
  MOD_RES (236): Any, other, or unknown amino acid
  MOD_RES (259): Any, other, or unknown amino acid
  MOD_RES (271): Any, other, or unknown amino acid
  MOD_RES (287): Any, other, or unknown amino acid
  MOD_RES (306): Any, other, or unknown amino acid
  MOD_RES (373): Any, other, or unknown amino acid
SRCRFCCRLSAAFLPRAMLGLAIVLAGRLNEGDRFLKPPISLRNFSFWSSFSKPAVSHWPNWVPVHFLVSEASVLPDSRSISSCKAFRLTWSMCASSMLPFFSNTTSKSVSVSSLQGSPATPLSFLFFLVFLFRAGSSMTGCSTFFLDFIFFFAEDLGSSLMGMYSGASTLTGFFLLPFLGLLSMDLEGLEWPGRASPSWWIFFFFFTFPLCSLGLFRLPFLXPRLPVPHPSSPLXQVSPTSLASLASQNQGSWTEKAXGVLGPPFFPSCXFLSFLPTLVSSSPCLXVLGRFSPQRHGTWLEVTSXFFFSPLRNSKWPNTCFLRLGDFSVRLAGSVVSGSTCSSQRVLTPFFFFFFFFTRGISGACPWATLLXGGCSS

SEQ ID NO: 619 - protein, 269 aa, Homo sapiens
  MOD_RES (7): Any, other, or unknown amino acid
  MOD_RES (11): Any, other, or unknown amino acid
GTGSLGXRNGXRKSPREHNGKVKKKKKIHQEGDALPGHSKPSRSMESSPRKGSKKKPVKVEAPEYIPISDDPKSSAKKKMKSKKKVEQPVIEEPALKRKTRKKRKESGVAGDPWREETDTDLEVVLEKKGNMDEAHIDQVRRKALQEEIDRESGKTEASETRKWTGTQFGQWDTAGFENEDQKLKFLRLMGGFKNLSPSFSRPASTIARPNMALGKKAADSLQQNLQRDYDRAMSLEVQPGSRLAVFSTAPNKIFYIDRNASKSVKLED

SEQ ID NO: 620 - protein, 218 aa, Homo sapiens
  MOD_RES (111): Any, other, or unknown amino acid
  MOD_RES (115): Any, other, or unknown amino acid
  MOD_RES (128): Any, other, or unknown amino acid
  MOD_RES (151): Any, other, or unknown amino acid
  MOD_RES (156): Any, other, or unknown amino acid
  MOD_RES (163): Any, other, or unknown amino acid
  MOD_RES (179): Any, other, or unknown amino acid
  MOD_RES (181): Any, other, or unknown amino acid
  MOD_RES (199): Any, other, or unknown amino acid
VRVCFLPPRVSCYPTLFPLLPRLPFQSWLLDDWLLYLLFGLHLFLCGGLRVITYGDVFRSLNFDWLLFTSFPRAALHGPGGLGVAWEGISLLVDFFFLLHLPIVFSGALPXSVSXPKAACSSSFFPTXASVPNIPGLPGLTEPRVLDREGXWGPGXPFFSFLXFFELLANSGFLLTLSXGXGEVFTPEAWDMARGDFLXFLFPTEELQVAKHLLPEAG

SEQ ID NO: 621 - protein, 389 aa, Homo sapiens; identical to SEQ ID NO: 487

SEQ ID NO: 622 - protein, 109 aa, Homo sapiens; identical to SEQ ID NO: 470

SEQ ID NO: 623 - protein, 96 aa, Homo sapiens; identical to SEQ ID NO: 472

SEQ ID NO: 624 - protein, 218 aa, Homo sapiens
  MOD_RES (203): Any, other, or unknown amino acid
CCTEHRWPASMPPQLQETRMNRSIPVEVDESEPYPSQLLKPIPEYSPEEESEPPAPNIRNMAPNSLSAPTMLHNSSGDFSQAHSTLKLANHQRPVSRQVTCLRTQVLEDSEDSFCRRHPGLGKAFPSGCSAVSEPASESVVGALPAEHQFSFMEKRNQWLVSQLSAASPDTGHDSDKSDQSLPNASADSLGGSQEMVQRPQPXQEPSRPGSANHRHGI

SEQ ID NO: 625 - protein, 212 aa, Homo sapiens
  MOD_RES (150): Any, other, or unknown amino acid
  MOD_RES (209): Any, other, or unknown amino acid
NLQITSGLYPGRSPACALKFWRTVKTVSAGDTQAWAKLSLLGALQSASLRLSLWLEPSLQSISFHLWKNVINGWYLSFQRLLLTLAMTQTNQTKVYLMPQQTPWAVARRWCNGPSLHRNRAGLDLPTIDTGYDSQPQDVLGIRQLERPLXLTSVCYPQDLPRPLRSREFPQFEPQRYPACAQMLPPNLSPHAPWNYHYHCPGSPDHQVXIWP

SEQ ID NO: 626-629 - skipped (4 entries)

SEQ ID NO: 630 - protein, 184 aa, Homo sapiens [sequence omitted]

SEQ ID NO: 631 - protein, 138 aa, Homo sapiens
GPWLTFPAFDPSHPISSSFPLPAAKKKKKETFIMNQQGFSPYQREMWKELKKPPFVPNSTLPIFYATQTLSFWVPFLQMDLLRRIIVFHVFSPQVTKINICIYNLYYCYIFVDNTFRWCWVIYYNLNLGISFGLPQSC

SEQ ID NO: 632 - protein, 91 aa, Homo sapiens
WVKGRKGKPWSSNPISSSFPLPAAKKKKKGNVYHESTGFQSLSKRDVERAKETTLCSQLHFTHILCNTNTVLLGPFLTDGPLEKNYRIPRF

SEQ ID NO: 633 - protein, 111 aa, Homo sapiens
  MOD_RES (91): Any, other, or unknown amino acid
  MOD_RES (97): Any, other, or unknown amino acid
RNHAKIQLPMQAPQSLILSSQFCCQATVVWRLVGCCPCCNEWEEVDSGMVETFTSSSPATGIPPRPVLCCGGRFKSKKLLFEVGFAVWFKXHDAIAXERPSKDSGLPGLEN

SEQ ID NO: 634 - protein, 89 aa, Homo sapiens
  MOD_RES (88): Any, other, or unknown amino acid
LRRNCPVQRPTFPFAPHLFRTPLHTLQPPKVPGSGFLHPAAATNANSLNSTFSVLPQRFPQFQQHRAVYNSFSFPGQAARYPWMAFPXQ

SEQ ID NO: 635 - protein, 89 aa, Homo sapiens
  MOD_RES (18): Any, other, or unknown amino acid
  MOD_RES (24): Any, other, or unknown amino acid
FIQFSRPGSPLSLDGLSXAIASCXLNHTANPTSNSNFLDLNLPPQHNTGLGGIPVAGEEEVKVSTMPLSTSSHSLQQGQQPTSLHTTVA

SEQ ID NO: 636 - DNA, 13 bp, Artificial Sequence
  Description of Artificial Sequence: Partial cDNA sequence e.g., EST or contig S
gcctcaagttatc

SEQ ID NO: 637 - DNA, 29 bp, Artificial Sequence
  Description of Artificial Sequence: Consensus sequence C
atgtcctagcctcaagttatcagatgcaa

What is claimed is:

1. An isolated nucleic acid consisting of SEQ ID NO: 33.

* * * * *